United States Patent 12,790,634 (MOST PROBABLE NUMBER ANALYSIS OF HETEROGENOUS POPULATIONS) - sequence listing, part 30

SEQ ID NO: 21 - DNA, 5415327 bp, unidentified (residues 1-1,805,109 of 5,415,327)
  source 1..5415327: mol_type = genomic DNA; note = Faecalicatena contorta
tcttcaaaactgcatacaaagaattaaatccatccattatcctatcaccttgcttggttatgccctcgacctattagtaacagtcagctccatgtgttgccacacttccacctctgccctatctacctcgtcgtcttcaaggggtcttactaacttgacgttatgggatatctcatcttgaggggggcttcacgcttagatgccttcagcgtttatcccttcccggcttggctactctgctatgcccttggcaggacaacagatacaccagcggccagtccaacccggtcctctcgtactaaggtcagctcctctcaaatatcctacgcccacgccggatagggaccgaactgtctcacgacgttctgaacccagctcgcgtaccgctttaatgggcgaacagcccaacccttgggacctacttcagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcgcagtcaagccttcttctgcctttgcactctgcgaatggtttccaaccattctgagaagacctttgagcgcctccgataccctttcggaggcgaccgccccagtcaaactccccacctgacattgtcccccagccggatcacggctgatggttagaaacccaatactgcaagggtggtatcccaacagcggctcccttacgactggcgtcataagttctcagcctcccacctatcctgtacatgcaataccgaatcccagtatcaagctggagtaaagctccatggggtctttccgtcctggcgcaggtaaccagcatcttcactggtacttcaatttcaccgggtgcattgttgagacagtgcccaaatcattacgcctttcgtgcgggtcggaacttacccgacaaggaatttcgctaccttaggaccgttatagttacggccgccgtttactggggcttaagttcaaagcttcgcttgcgctaacctctccccttaaccttccagcaccgggcaggcgtcagcccatatacctcacctttcggttttgcatagacctgtgtttttgctaaacagttgcttgggccaattctctgcggcctctcgcgaggcaccccttctcccgaagttacggggtcattttgccgagttccttaacaatgcttctcccgtcggccttaggattctctcctcatccacctgtgtcggtttacggtacgggttttaactgaacaatagcggcttttcttggcagctagctcacgcacttcgctactttagttcgctccgcatcacgtcttcggattgcataccggatttgcctgatatgctcctaccacgcttgcaccggattttccacttccggcttgcgctttctctctgcgtccccacagttctgtcagttaaaagtacaggaatttcaacctgttgtccatcgactacgtctttcgacctcgccttaggccccgacttacccagagcagatcagctttactctggaaaccttagatattcggccggaaggattcccaccttcctctcgctactcattccggcattctctcttcttaacactccactgctccttacggtacagcttcgccgcagttaagaatgctcctctaccaattgacattcatcaattcctaagcttcggcagtgtgtttcagccccggacattttcggcgcaggacctctcgactagtgagctattacgcactctttcaatggatggctgcttctgagccaacatcctagttgtcttcgaaatcccacatccttttccacttaacacacattttgggaccttagctgtaggtctgggctctttcccttttgaccatccaacttatctcggacagtctgactcccatacatcatctacacggcattcggagtttgatattctttggtaagctttgacgccccctaggaaattcagtgctctacctccgcaagacttgagtatgaggctagccctaaagctatttcgaggagaaccagctatctccgggttcgattggaatttctcccctatccacacctcatccccacccttttcaacggatgtgggttcggtcctccattgccttttacggcaacttcaacctggacatggatagatcacccggtttcgggtctactccgactgactatattcgccctattcagacttggtttcccttcggctccgggccttcggcccttaacctcgccagccagcgtaactcgccggaccgttctacaaaaagtacgcggttgcacatataaagtgctcccacagtttgtaaacatatggtttcaggttctctttcactcccctcccggggtccttttcacctttccttcacagtactatgcgctatcggtcactaaggagtatttagccttacggggtggtccccgcttcttcccacaaggtttctcgtgtctcgtggtactctggataccgccatgtcatgttggattttgcttacggggctttcaccctctctggccagctttcccaaaactgttctgctatcttccatgaatcaattatgcggtccgaaccccagggtgcacgcaccctggtttgggctcttccggtttcgctcgccgctacttccggaatcacatgttgttttctcttcctccggctacttagatgtttcagttcaccgggttcccttccttaacttatggattgggttaaggatactggaggtctgctccagtgggtttccccattcagaaatctccggatcgatgggtatttgcccctccccgaagcttatcgcagcttatcacgtctttcatcggctcttagtgccaaggcatccaccatacgctcttattagcataaccaacttgccttctctcacgggttggagatcgggcgacacatatctagcgtgatatgcgttggcaataggttcctcttattgaactgctaatgttcaataaaattcaattttttccgttcgtttttttcgaactagttaatgttgttaacattacctcggatgtcttgattaaataagatatttaatctgtcgtattatcgcttatcagtaataatacaacttctctttgtatgcaattttcaaggtacatatccagatgttccgcttccgcttcccacccgctgactgctttatcagtcattacatacacgaattgtttcgtatatctaatcactggtaaaaccagctatcataacagcactgccctgctgattgggttggcgttgataagttgttgcttatccttgccggtatctatataatcaacatttatataatactgacggcgcttccgtcatcctgttattcttttttagatttggcggccacctactctcccacatcgtctccaatgcagtaccatcggccgtctgggtcttaaccatcgtgttcgggatgggaacgggtgtttcccccaggcgcatcgccaccaaaatattttgttatgtgagcatgccctttcaggcactctcttgataactaaacaatagacaacatactctttacttctttcttccttagaaaggaggtgatccagccgcaccttccgatacggctaccttgttacgacttcaccccagttatcggtcccaccttcggcagctccctcccacatcactaagcacgacttgtgacttgttcttttatcgaatgttatggaatccacagatggcttccataaccactgaacagtcatgctcactgatgtgggttgggtcactgacttcgggcgttaccaactcccatggtgtgacgggcggtgtgtacaagacccgggaacgtattcaccgcgacattctgattcgcgattactagcgattccagcttcatgtagtcgagttgcagactacaatccgaactgagacgttatttttgggatttgctccacctcgcggcttcgcctccctttgtttacgccattgtagcacgtgtgtagccctgctcataaggggcatgatgatttgacgtcatccccaccttcctccaggttatccctggcagtctctctagagtgcccggccaaaccgctggctactaaagataagggttgcgctcgttgcgggacttaacccaacatctcacgacacgagctgacgacaaccatgcaccacctgtctcccctgtcccgaaggaaaagcaccattacgcgccggtcagggggatgtcaagagcaggtaaggttcttcgcgttgcttcgaattaaaccacatgctccaccgcttgtgcgggtccccgtcaattcctttgagtttcattcttgcgaacgtactccccaggtggcatacttattgcgtttgctgcggcaccgaatggctttgccacccgacacctagtatgcatcgtttacggcgtggactaccagggtatctaatcctgtttgctccccacgctttcgagcctcaacgtcagtcatcgtccagtaagccgccttcgccactggtgttcctcctaatatctacgcatttcaccgctacactaggaattccacttacctctccgacactctagttacatagtttccaatgcagtcccggggttgagccccgggttttcacatcagacttacataaccgtctacgctccctttacacccagtaaatccggataacgcttgccccctacgtattaccgcggctgctggcacgtagttagccggggcttcttagtcaggtaccgtcattttcttccctgctgatagaagtttacataccgaaatacttcatccttcacgcggcgtcgctgcatcagggtttcccccattgtgcaatattccccactgctgcctcccgtaggagtttgggccgtgtctcagtcccaatgtggccggtcaccctctcaggtcggctactgatcgtcgccttggtaagccgttaccttaccaactagctaatcagacgcgggtccatctcataccaccggagtttttcccactgtaccatgcggtactgtggtcttatgcggtattagcagtcatttctaactgttatccccctgtatgaggcaggttacccacgcgttactcacccgtccgccgctcagtcacaaaacctttcattccgaagaaatcaaagtaaagtgcttcgctcgacttgcatgtgttaagcacgccgccagcgttcatcctgagccaggatcaaactctcgttaaaagtgtttgtatccgggtcagaattaactactagctaattctatccctttttactgttcttaccaccgagattaatctcagtgatgggtgcatcattatgatgctgttcttaaaaattttctctataagaaattttcaagggtttgttgtctattgtttaattatcaaggtgctttgttgtttttgctgtcgttctttgtcgtcagcggcaacttttatagaatatcatatccattgtcgtctgtcaagaactattttatttttcttttgctcttcagaactcatttctttctgtttcttcaagcgacagctttaatatattaccacactgccttactttttgtcaacaacttttttcaactaattttcaactgacttcataaattagaattcccaaattcatctcatctcaatcaactgttttatagaaaaagtggctgtttgaaacgacagcttagttagattatcacatttttatgtcatttgtcaacagcctttttcactttcccctattttccccgataattttcatatattaatttaagaatattctgaaaacggtgagcaaaggggtctgacccctctgctgctccctctactaattcgtttctctctttccgctgattgtctgagcgataatgtttctcataatatcctcgctcaattgtccgctcagataaccaaatacctttccttcctttgtaaacataaatgtagtgggataagactgaataccgtattggtcgaatatgcttccgccttcatccatcagaaccggataggtatacccgttctcctccagaaattgcttcacaccatctacagactgttcctgaccatatcccggagcagcaattccctgtatcacaacctcaggatcttcttccttttggtattcttcatagagcttttgtatttccggcatctctgcacggcacggtgggcaccatgtcgcccagaaattcaggaagacggtcttccctttatagtcagaaagcttatgcacgttcccatactgatcctttaattcaaaatctatggcatccggaagttccgccgccctgtcctgttctgaatcgtcatttttatctgcactatcctttgtattactatcattattttgcgctttatcatctttctctgcagtatcacccgctgatttttgttcattttcagatacctgcttttctgtcttcgtattatcctgctgcgcagtctgtacttctgatagatatcccgtaattgcattcatttttccagtgaacatcataagacccattaatatcatgagtactccgcccaccttcactgtatatttgacaacattattatgttttttaaataaatccagtaaagttgtactgaagatgcctactgctaaaaacggaagtacgaatccaagggtatatacgccaatcaacgcaaatccccacaccttcgtgcttgcagacgctgacatcagcaggacactggacagagccgggccgacacagggtgtccacgcaaaactaaaagtaaatcccataatcagtgcggtccaaggtgacatagccagtttatccaaatggaacggcagcctgtgttcctgactcaaagtcttggactttccgaatactcccagctgatagaatccaaatacaactatcagaatgcctccgatccgtgcaaacatactctggctgcctttgaagaagcttccaagcaccgaggcgccaaatcccagcaggaagaaagtgaaactgactccaaccacaaagaacaacgtatttaccataactttttttctgctgaaatatactctgccgtcctcgccgaccttccgggtgcctcccgctagatatccgatataaagcggaatcagcggaagcacacatggcgagaagaaactcaataatccctgaacaaataccgtaagaattggcacgcttatgtctaatgaaaatcccatatcttaatctccctattttaagtattttttatagtgcaacatccaggatctgatgacatcgaaatattacatctttagacactgaataaatcattcaatgcttcccccatcgtcggatgtgtaaatatcatatttttcagaaccgtatagtcaagtccggcatccatagccacttttataagatttatcaattcatgtgactcctcgcagaaaagatgtgcgccaagtattttattcgtgtcagcatcaagaacggctttcagcagtccgtccggctgttccagtacctgcgcctttggaattgccgctgcgggaagctttgctgtctttacatgatagcctgcctcaacagcttccttttcactcatcccaactcttgagaaaggcgggtttaaaaatacactgtacggtaccgcgcctcgtttgtcaagtgtgtagctgccatccccaagaattttagaagccacaatccgataatcatcaagtgagatataggtaaactgcagtccgccggttacatctcccattgcaaaaatattcggtgctgttgttgtccttgaattgtcagttatgatgccgcccctttcattgacatgtacgcccgcagcttccagattcagttcttttgtattaggcctgcgcccggttgctacaagaaccgcctctgccggaagtatgtctatgtcgtctttagttttgataacaacttctgcaaaaccttctttttgcttaatttcctgaaccagaacctccgtgagtaccctggcgcctctattttctagattctgttttaccatatctgcgatctctgtatcttctctcggcaaaaataccggaccatcctgcaaaatcgtcacatctactccaaaatccgcataaatcgaagcaaattcaacacctatgtaaccaccgcctatgattaccaggcgttcgggaagcgtctccttatccagaagattttcgctgatatagacatacggatttccctggatcccctgaataggtggaataaatggtgaagatcctgtattgataaaaaatcgctcgctttccagtaccaggacaccatctactctttgtacctccactttatgatcagaaataaaacgggccgttccatcaataattgttatattgggattcgtatccaacttcttataattcttcaatctcagcctctctacaagctgtgtttttctagccacagcattcacataagcaatacttttttctatgcatctactagctgcattcccagcactgtgaaccagtgacttcgtaggtatgcatcctacattaatacaggttcccccgtacatctttgccgacttttcgatcagcgccacctttcttcctgatttctctaatgcacccgcaatcgtttttccaccttttccaaatccaataattatatcatcatatttcgtattcatagttccctcccggaatctgtatcttttattgtttcagttattactgtaacaatagcagatacagttagatctgtcaatagatttccaaaaaaaatcacagccctttttaagttttataataaaacttaaaaagggctgtgagattcactataagaccatattttgttatgttattgaggcatcgtatatttcctgaatcgattccgcaagcatactgtcaaattctgcctgtgtctggtcggcccgcagtccctgtgtcaacgcacgtgagaaactcgccaccactcccggattatctgctagcagtgtatttgcctcttttctgctgtatcctccggaaagagcaaccacacgcactactttcggatcttccagaagatcgctgtaatagccgttttgacttggaagcgtcagtttaaacatgagcctggtatcttccggtaccctatccagatgacgaagcagttctcttttcaggatcttctctgcttgttctttttccggactgttgatatcgacttccggctccagaatcggtaccagtcccctcttgacaatcaacatgccgacagcaaactgctgttctacaatctcacgtataccatcctcattcgcgagcttgatcacggagcgcatcttggtcccaaagatatgtctctctttcgccctgctcaggagttctttcagattcggaatctgtttcatgatctgaacaccggcctcttccttttccaggcctttgtctaccttcagaatcggcagaatccctttttcctccagcagataatctgcggtatactttccttccatttttctgtccatcgtattctcaaatagaatagctgccagtatgtgttcagaagtaaaggcattactcgtaataattctagtccgcatcttatgtatcagttcgaacatctcatcatcattgtgatactgcgactcatcaattccatatagcctcagagcttttggagtgcttccgccgctctgatccaacgccgcaatgaatccattaccttcgtgcatcctttttaattgtacttcgttcatctttcatacctcccatctaacgaagccttcacctgaaacacattagtgtgttttcattgtaccacgttttctcacaattctcacctttttttatatatttctgaatattttgtttgcaatagttactattcacgaccgtaagccgcacatagaaacttgcaatattactcatgttccgctaatattaattaagagctgctacagaaacagttcgtatttcaatctataacgacaaatgagaggagaattctagatggagtttgtgcataataaaaatcaaatcgccgtatatactccggattatctggtagtggctgaggtcacctttcctgagatcgatgccgacacggttaatgttaatcacacatatgtggacgctgtgctgcaggggcagggtgttgcaggtaaactcatggaggaactggtctctgaactccgtcaaagcgggcaaaaggctgttctcacctgctcttacgcagtaaattggtttgataaacatccggagtatatggatgttctgaaaaaataacccggactccccgcctgctttaaatgtaaaatgtccgccggagcacatcaattctaatccatgaatctccgccggacatttttacttttctatcttcagtttttatattttgttattaccgtttgttgaattcttttaaaactcattttatatctctattttaaatgaaatgcatttttgatttcttcaatctgttcttcactgattggaaccatttctcccagattcttagcaaatacaagcgcctttgcactgtattccgctacctccagacggtcaaatgcattgagcaggctatctcccgttacagctaagcagtcattgctaaccatgacaatcggagtactttcatcaaactgctgagcagccttatccggattctgatagaattctgagtattccactttaggtatatccctcattagtatataactttccggtatagattttgaatctaaagtttcatccgttacggcgtatgccatgatatacggtggatgcgcaatgataacggaattgatttccggatgctgcttatagatttcatcatgtatcttgatggatcggctcggaaccttacccgcttccctcatgtctcttttgatgcagacaatatcttctacatcaatatatttcctgtctacattataaggagatatcaaaaatcgttcttcatccagcctcacagaaaaagatccctgagtggagttcaccagcccctggtcgtatgcacggtgaatgatgttgcacatatcccttcttgcggccttctcgccgcttgtgatattatttctcacgaattcatccatattcaaatgattcttcgtatacttaagctgaatctcttctgccattaaatatcttggcgttccgataatagctgcgttgatctgaagccgggcacaaaagtccaggttctcaaatgctttaaatgcattaaataggctgtcacttccaactactacaccatggttttctaaaacggcaatgtcacatcctttggcaaattccttagcaatcttatccccgagatcctgacttcctggcagtccatattctgccatagcgatccggccgcatcccacaaaggagttcggactcagcaatgtattcggtatccctctgacaatgctgaaggcaaccaatgccggtggatgtgcatgcagaactgattttatatcacttcttgttttatagatttgcaaatgaaatgggtattcactggatggtttatgatttcctataatagtaccgtcatttttaatgcatacgatatcatttcttgtcaaacttcctttatccacactgcctggtgtaatccacacatctccattatcatccagaatggacagattacctcctgatgttgtggtcatcccataatgatagatacgatccatcatcatgaccagctggtctgcaggatgtaataaatttatattcatataatcactccttcttcattgaaatgttttttcttgactgtttatgtatttattatattggttttatgtggttttgtcaatatatttatgtggtttttatttgtttttattcaattcaaattagataacagtgtaggcgtgccagctgcaccccttctttccctcatgctaacgaggctgcacactttgcgctccgcctggatactatttttttacggctagtagatcgtaaaataaacatttcacaaaaaatggcagatagtcccgcttgaccatctgccatttacattctttcgtgattcatcccccacctatagaggtctgattattcctgcatgtattttgcttttaattcgttaaccatttctgcataagcgctgctctgcatctgctgaagcatactcgtcttaatggactccttcacctcgcttaaaggagctattgacgcatcttctttcccttccactttaatcagatgatagccaaactgactctctaccggtccgactatatgccctgcctcagcagcaaacgctgcatcctcaaattcttttaccatctggcctctgccgaatttgcccagatctccgccgttctcttttgatgggcagatggaattctctctggccgcatcctcaaaactcttttctccgcttgttatagactctaatatagagctacacttttcctctgaatctgtgaggatatgttttgcacttaccatctctcccttggtaaactgctgcatattcgcttcataatatgcggacacttcctcatcagatatagtaatgtctttcataatttcttccattgccatctgcgcaaggatatctctctttgcattcaccagaaacttctcatatttctcggtctgatccagcttcaggtcgccacccattttcgcaaacaaatgcagtgcaatcaactgctccaaacactgctgtctgaactgaggattagatatgtaagcctggcggtctctcggaacgttaagcaaaaatgcatcaaactcttcctgtgtgatctcttctcctgcaacaactgctaatacttcctgactcatatgtatattctcctttttatataatatgtccattatagtttgatttcatgaaacatgcaagggggtcagacccttttgctcatcgttttcagaatattctaaaattaacaaattttaagacaacaactactgtcagcacaagttgggggttatgatttatgtaactaaaaaaacgataccttccggtaccgtctcctcattccatatgtatataccctcaaaactgcatacaaagaattaaatccatccattatcctatcaccctgcttggttatgccctcgacctattagtaacagtcagctccatgtgttgccacacttccacctctgccctatctacctcgtcgtcttcaaggggtcttactaacttgacgttatgggatatctcatcttgaggggggcttcacgcttagatgccttcagcgtttatcccttcccggcttggctactctgctatgctcttggcagaacaacagatacaccagcggccagtccaacccggtcctctcgtactaaggtcagctcctctcaaatatcctacgcccacgccggatagggaccgaactgtctcacgacgttctgaacccagctcgcgtaccgctttaatgggcgaacagcccaacccttgggacctacttcagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcgcagtcaagccttcttctgcctttgcactctgcgaatggtttccaaccattctgagaagacctttgagcgcctccgataccctttcggaggcgaccgccccagtcaaactccccacctgacattgtcccccagccggatcacggctgatggttagaaacccaatactgcaagggtggtatcccaacagcggctcccttacgactggcgtcataagttctcagcctcccacctatcctgtacatgcaataccgaatcccagtatcaagctggagtaaagctccatggggtctttccgtcctggcgcaggtaaccagcatcttcactggtacttcaatttcaccgggtgcattgttgagacagtgcccaaatcattacgcctttcgtgcgggtcggaacttacccgacaaggaatttcgctaccttaggaccgttatagttacggccgccgtttactggggcttaagttcaaagcttcgcttgcgctaacctctccccttaaccttccagcaccgggcaggcgtcagcccatatacctcacctttcggttttgcatagacctgtgtttttgctaaacagttgcttgggccaattctctgcggcctctcgcgaggcaccccttctcccgaagttacggggtcattttgccgagttccttaacaatgcttctcccgtcggccttaggattctctcctcatccacctgtgtcggtttacggtacgggttttaactgaacaatagcggcttttcttggcagctagctcacgcacttcgctactttagttcgctccgcatcacgtcttcggattgcataccggatttgcctgatatgctcctaccacgcttgcaccggattttccacttccggcttgcgctttctctctgcgtccccacagttctgtcagttaaaagtacaggaatttcaacctgttgtccatcgactacgtctttcgacctcgccttaggccccgacttacccagagcagatcagctttactctggaaaccttagatattcggccggaaggattcccaccttcctctcgctactcattccggcattctctcttcttaacactccactgctccttacggtacagcttcgccgcagttaagaatgctcctctaccaattgacattcatcaattcctaagcttcggcagtgtgtttcagccccggacattttcggcgcaggacctctcgactagtgagctattacgcactctttcaatggatggctgcttctgagccaacatcctagttgtcttcgaaatcccacatccttttccacttaacacacattttgggaccttagctgtaggtctgggctctttcccttttgaccatccaacttatctcggacagtctgactcccatacatcatctacacggcattcggagtttgatattctttggtaagctttgacgccccctaggaaattcagtgctctacctccgcaagacttgagtatgaggctagccctaaagctatttcgaggagaaccagctatctccgggttcgattggaatttctcccctatccacacctcatccccacccttttcaacggatgtgggttcggtcctccattgccttttacggcaacttcaacctggacatggatagatcacccggtttcgggtctactccgactgactatattcgccctattcagacttggtttcccttcggctccgggccttcggcccttaacctcgccagccagcgtaactcgccggaccgttctacaaaaagtacgcggttgcacatataaagtgctcccacagtttgtaaacatatggtttcaggttctctttcactcccctcccggggtccttttcacctttccttcacagtactatgcgctatcggtcactaaggagtatttagccttacggggtggtccccgcttcttcccacaaggtttctcgtgtctcgtggtactctggataccgccatgtcatgttggattttgcttacggggctttcaccctctctggccagctttcccaaaactgttctgctatcttccatgaatcaattatgcggtccgaaccccagggtgcacgcaccctggtttgggctcttccggtttcgctcgccgctacttccggaatcacatgttgttttctcttcctccggctacttagatgtttcagttcaccgggttcccttccttaacttatggattgggttaaggatactggaggtctgctccagtgggtttccccattcagaaatctccggatcgatgggtatttgcccctccccgaagcttatcgcagcttatcacgtctttcatcggctcttagtgccaaggcatccaccatacgctcttattagcataaccaacttgccttctctcacgggttggagatcgggcgacacatatctagcgtgatatgcgttggcaataggttcctcttattgaactgctaatgttcaataaaattcaattttttccgttcgtttttttcgaactagttaatgttgttaacattacctcggatgtcttgattaaataagatatttaatctgtcgtattatcgcttatcagtaataatacaacttctctttgtatgcaattttcaaggtacatatccagatgttccgcttccgcttcccacccgctgactgctttatcagtcattacatacacgaattgtttcgtatatctaatcactggtaaaaccagctatcataacagcactgccctgctgattgggttggcgttgataagttgttgcttatccttgccggtatctatataatcaacatttatataatactgacggcgcttccgtcatcctgttattcttttttagatttggcggccacctactctcccacatcgtctccaatgcagtaccatcggccgtctgggtcttaaccatcgtgttcgggatgggaacgggtgtttcccccaggcgcatcgccaccaaaatattttgttatgtgagcatgccctttcaggcactctcttgataactaaacaatagacaacatactctttacttctttcttccttagaaaggaggtgatccagccgcaccttccgatacggctaccttgttacgacttcaccccagttatcggtcccaccttcggcagctccctcccacatcactaagcacgacttgtgacttgttcttttatcgaatgttatggaatccacagatggcttccataaccactgaacagtcatgctcactgatgtgggttgggtcactgacttcgggcgttaccaactcccatggtgtgacgggcggtgtgtacaagacccgggaacgtattcaccgcgacattctgattcgcgattactagcgattccagcttcatgtagtcgagttgcagactacaatccgaactgagacgttatttttgggatttgctccacctcgcggcttcgcctccctttgtttacgccattgtagcacgtgtgtagccctgctcataaggggcatgatgatttgacgtcatccccaccttcctccaggttatccctggcagtctctctagagtgcccggccaaaccgctggctactaaagataagggttgcgctcgttgcgggacttaacccaacatctcacgacacgagctgacgacaaccatgcaccacctgtctcccctgtcccgaaggaaaagcaccattacgcgccggtcagggggatgtcaagagcaggtaaggttcttcgcgttgcttcgaattaaaccacatgctccaccgcttgtgcgggtccccgtcaattcctttgagtttcattcttgcgaacgtactccccaggtggcatacttattgcgtttgctgcggcaccgaatggctttgccacccgacacctagtatgcatcgtttacggcgtggactaccagggtatctaatcctgtttgctccccacgctttcgagcctcaacgtcagtcatcgtccagtaagccgccttcgccactggtgttcctcctaatatctacgcatttcaccgctacactaggaattccacttacctctccgacactctagttacatagtttccaatgcagtcccggggttgagccccgggttttcacatcagacttacataaccgtctacgctccctttacacccagtaaatccggataacgcttgccccctacgtattaccgcggctgctggcacgtagttagccggggcttcttagtcaggtaccgtcattttcttccctgctgatagaagtttacataccgaaatacttcatccttcacgcggcgtcgctgcatcagggtttcccccattgtgcaatattccccactgctgcctcccgtaggagtttgggccgtgtctcagtcccaatgtggccggtcaccctctcaggtcggctactgatcgtcgccttggtaagccgttaccttaccaactagctaatcagacgcgggtccatctcataccaccggagtttttcccactgtaccatgcggtactgtggtcttatgcggtattagcagtcatttctaactgttatccccctgtatgaggcaggttacccacgcgttactcacccgtccgccgctcagtcgcaaaacttttcaatccgaagaaatctaagtaaagcgcttcgctcgacttgcatgtgttaagcacgccgccagcgttcatcctgagccaggatcaaactctcgttaaaagtgtttgtatccgggtcagaattaactactagctaattctatccctttttactgttcttaccaccgagattaatctcagtgatgggtgcatcattatgatgctgttcttaaaaattttctctataagaaattttcaagggtttgttgtctattgtttaattatcaaggttcttagttgtttttgctgtcgttctttgtcgtcagcagcaacttttatagaataccatgttcgttgcagtctgtcaagaacttttttatttttcttttccgcatcgggctcccagttatttccagtcactcatacgacagctttaatagcttaccacatcacgctgctatttgtcaagcatttttcgacatttttcaacttgatctgccagttgattgaacctctgcataactcctgtctggctcagaagcttccgctctgccagtctcgcttgcagcaggtttgtcatccgcgatggaacttaatattatcattccagttcgtaattgtcaataattttcttgttttttattttattcatacatttcagacaatttattgttagttttgacagcgctgttatgcaattttttttactgatgcggttcccaatgacattcagaaaatattgcttctgaaaacaccgcttggaatgaagatttttcagggctgcatgcgtataccccaacattaacatgcccttccccttggaaaagatgtgcaattctcatctgcttaaaatgaattccgtcgtaggagttttccacaagataatcactcttacgcctgctcagtctgtaaaacatgctcttctgatccgccggaatatccgtagtcgcccagtctgaatatccacaattggtgactacgcttcccaggcgctgaaaatactcattctcgtattctatagatgctttcagccagttatcgctatcctgatataccataatgccacactgatcaaatctgtgggtactgtcaaattcggttttaattgtaaatgaaaagtagggctcgtcagtttttatcagcagcgcaggtgcattgtcattgcggaatccataataggtacgctgccaaaagtccgtttccggttctgttatgatagctagcttcccctcttcaaagtgatacagggtgggttcatgtatccagaatgtattattttttgtaaactccattaccatttctccttttcttggactgatatcattactcttcttccttctacacttaatatacaacgttttataaaagattcattgcatcattaatcgttttaacacctactattttaattccttttatatctttcaccatatctcttgatacagctggcagtacacaggtctcaaaccccagtttttttgcttctgacactctctgctccggcatattgactgcccggacctcaccgctcagccctacttccccaaatacgatcattttctcatcaattggccggttcttatagctggaaaccaacgccataataattcccaagtcgattgcaggctcattcatcttgatccctcctgctatatttacataggcatcataattggaaagcggcagcccgattcttttttccagtacagccatcagcagattaactctgttataatctgtgcctgctgccgttcttcttggaagcccaaaattactctggcagacaagcgcctgtatttcaatcagaatcggccttgtgccctccatcgaacatgctactacagaaccggacgcattttccggtttaccgcttagcatatattcagaaggattttccacttctgtgagccctgtctgtctcatctcaaacacaccaatctcattggtagagccaaaacgattctttacacccctcaagatccggtaggacgcatgcctgtccccctcaaaatataacacagtatccaccatatgctccagaactcttggccctgcaactgttccttcttttgtcacatgtcccacgataaatatagaaattcccaggccttttgcaagctgcataaaaacattcgttgattccctcacctgggatacactgcccggtgcagaagatacctcttcactgtacatcgtttgaatagaatcgatgatcaccagttgggggtgccggccctcgataatattcttaattgtctccaggtttgtttcgcacaatagcttgagattttccttaaattcccccatacggttcgcccgaagcttgatttgtgccagagattcttcacctgatatatatagaatgttcttttcttgtgacagccgctgacatacctgaagcagaagtgttgattttccgattccgggatcgccgcccaccagtaccagggaacccggaacaataccgccccctagtacccggtccaattcctgtatccccgtcagaatccttgtgtgatcgtccgcactgacctccgagagcgatacaacctccgcctcccttacagtcttaaccactgctgtcttcgcggtacttaccttctcctcaacaaaagtattccattccttgcaggcagggcactgccccagccattttgactcctcatgcccgcagttctggcagaaaaatacacttttttttgccttcgccataatgctccttcctcccaggtacctcatagggggctgctcttttggaaaaaggatcagacccctatgaggtacctatgaaaaagagacaggcttatgtttccctgtctccttttttattgctttatgcagataattccagtactagcactttgatacactgacagtcacgctgtctccttcgcttacttctgtgctgacgcttaacttgccgcttaagtttgtcatcatcttgccagctgttgtaccattgataaatacttcatactcactgtctggttccagctctaatgtgaactgtacgtcttcaggtgcggatactgtgaaagtcacttctgcatcagtagccttgaagttctctactgtgctgcccggtacggattcgtatacgaacattccgttcttctccagcttcgtgatctctttaaatgtcttcactttatagatatcgccttcaaattcgaaattgtccatttttgtcttggttgctaatgtatagtctccaaaactgagtgttccgtcatcttctgcgcgtagtagttcttttactgttgccatttttattatcctcctaggtatttcagattgatggttatcctgtttgtattatataatacttcgtttttattttctactcatttatggactttgggtaaaatttaatttcttttttagatactcctgcctccacacggtccccttcttttacttcaccgcttaagatcgcctcagccagcttatcctccagttctgtctgcatggctctcctgaggggacgggcaccatattttgcatcggtccctttctcgacaatgaatttcttcgcagattccctgatcgtcagttttatactcatctgttctttcacgcgttttgtaaattctctgcacatcagagttacaatctgcttcatatgggtattgttcagcgcatggaatactataatttcatcaatccgattcagaaattccggacggaagatcgttttcacctcatccatcacgttctgcttcatccgcttataatcccctgccggatcttctttggcagcaaatcccagtttcttaggctctacgattgcttttgcacccgcattggatgtcataatgattaccgtattgcagaaatctactttccgcccctgggaatctgtgatatggccgtcatctagcacctggagaagtatattaaatacatccggatgtgctttctccacttcatcaaataaaataaccgaataaggatgcgtacgcacctgatcactgagctgtccgccttcttcgtggcccacataccccggaggagaccctatcatcttagatacagagtgcttctccatatactctgacatatcgacccggatcatagaatcttcgtttccgaacatcgcctccgcaagcgcttttgatagttccgtctttcctacacccgtggggccaaggaacagaaaagaaccaatcggacgttttgggtcttttaatccaacacgccccctcttgacggctctggccaccgcactgactgcttcctcctggcccacgacccttttatgaagaacctgttccagctttttcagtctgtccgtatcgctctcagcaagcttctgcaccggcacttttgtccacgcagataccacgtcagcaatatcgtcttctttcacttccggatggtgggatgccgtctttttctgaaaacgctttttcaagttttccagcttatcctcaaccgctttctgttcagtgtgaacaagagatgccttcgtaaagtcgccggatttaatgcactcctctttctgcttgagcagttctttcagggaatcttccagacttttaagattctccggcactttataacctcgcatactgaccctggaacatgcttcgtccaggacatcaattgctttatccggaagatttctgtctgtaatatatctttccgaaagctgtaccgctgcttcaagggcctcttcccgtacagacaccttgtggtgggcctcatatttaccgctcagtccatgcaggatctcaagacattgctctttggtcggctcctctactgtaatcggctgaaaccggcgctccagagccgcatctttttcgatatattttcgatactccgctatcgtcgttgcaccgatcagctgcatctcaccgcgggcaagggatggtttcagaatactggaagcgtcaatcgcgccttccgctccgcctgctccaatcatcgtatgcagttcatccagaaagagaataatattgccgctggccttcacatcgccaatcagccctttcatacgctcctcaaactccccgcggtacttggaacccgcaatcagccccggcagatccagggtgtaaatctttttgtctttcatattttccggcaccacacccatagcaatcctggaagcaagcccctctataatggcagtttttccaacaccgggttcacctaccagacaaggattgttctttgtccttctgctcagtacctgcatcagacggtagatctccttttcccgtcctacgacagggtccagacggccctctgccgcctcggcagtcagatctgtacaaaactgctccaccacggcgctttttccgtgagtttcatcctgcagttcctcctgatattctttgggatcaacacctgccgcattcaatacgtcctgtaaaatcttctgcagactgatattaagcgtagtcaatatcctggttgcaacacagtccacatcgtggatcattgccagaagcagatgctctgtacctatgcttttcgtgtgaaggcaccgtgcctccctgccgctattctccagcagatactgcagccgcgggctctccttcggatgctctacactcagcacatcccctgccggtgtaatcagctcatccatcagatggaggatgcgctcttcatccacgctgtttgacgccagaatctgtccggccacccctgtaaactccttgcgcagccccagcagcaaatgctccgtaccaatatacggatgcttcagcttttttgccatcgatgccgcatattttatggcgcattcggcctgatttgtataatttatctgcatattttcctcctgtcactaatcaatccaatttaaaattatttcgctttcataccagcataaagtgagactccgtctaagagtctcttaaaaggccccatcatacacatcaaatatttcatccaccagatgatgcacttcttcccttgaaatattcttacaacagccctttgccagtaaaattgtaagctgctccctcatctcgtccagtgccttcatcttatccacgtcgagggcaatgacagctccccgcctcctgtcgagctgaataaacccttcctgcttcagaacgctgtatgctttatttaccgtatgcatattcacgcccactgtgtccgcaagctgacgcacagatggaagcgagtccccttcatgaatcgtagaagtagcaattcccataataatctgattacgcagctgaatataaattgcctcttcactgttaaaatctatctcaatcagcatatcatcacctgcctttttttgttatacctatgttagcacaaacaccctagtccccgcaagtgaaaattgtgggtgattattcatataccggagctatgctgtgccaccaaacatatcaatacgctgcctccgttaagaggcctccccggttgacgaccttacctaccgattggatgcacttagcgaaaggaagggatggccgcaagccgtccaggtgcacctatgccgcctcgaaatgctaaagcgggccttagaaattcttggaagccgacagccgggaaagtggagggattttgtgatctccgaatcacaaaatcggatgacccagcgcgagaaatcatcagatttctcgtgatgtgtcatccgtaccccactttctcggctgtcagattcctagaatttcttaggttcgcgtccgcatttcgaggcggcataggtgcacttgggcggcttacggccatcccttccttttgcggccccgtcaaaccgcccgcagtttctccacaaactcattagaaagagaaatttttgccacatagaatacttccccggtcatgtaaacttcccagttatcatcgatctctacctgcagtttccctcccggcatgtgtacgattactttatttccggtcaggcccagtttgtgggccactcctgccgctgcacacgctcctgtgcctgttgccatcgtgtaaccggcccctctttcatatgtttctatggcaatattattgttgtcgatcactttcataatctctgtgtttattctgtctggaaaataccttgcaacctcggaataattaccgatcttgcatacaagcggctgtgagatctcacgcattgggataacgcagtgaggattgcctacggatacacaggttaccggatacaatgtcctgccgaataccatgtcttcattgatgacctcgcggcgctctcctgtcaccggaatctcatcgctccagaaggacagccgccccatggaaatacgcagcctgctgccatcctcgttcagatacgtaatttccactagtcctccgtctgtcacaagtttgtaatttttcttctgtacatagccggcatccttcaggtatttggcaaaaatacgcactccatttccgctcttttcggcaacgcttccatccggattccatatgcgaagagacatgtgcttttccccgataaacggaccttccagtatcccgtcagagcccagccccatattgcggttgcagagcatctccacatttgctttatttaattctaattcattcttattcggatcataaaccagataatcatttccaagaccatgataacgttccaatgtaattttcataataacgcacctcctgtttctatcattatatcaggcatttttttcatataatacttattaaatgcttttcacattgcagataatgctctatactatatttgacaggtatttacgcggggcagtctggcccttgcagggaatgcctggaggcacacggatccatgtgtctttatcccttgcaatcataacggaaaggagacgcttatgcagcagtacaataaaagaggatatctgaacagcgatttccgtatattccatctaaaggacagtatctccaaagagtttgaatttcactaccatgactttcataaaattactatatttataaagggtaaagtacaatacatcatagaaggcaaatcttatgaacttgaaccttacgacattgtactggtgaaccgcaacgatatccaccgcgtgcaggtggacaattctctgccctatgagagaatcatcgtctatatttctcccggttttatggaggattatcagacgccggaatatgatctgaattactgcttcgagaaagcaaaaaaggaacgctccagtgtacttcgaatccattcactagagaaaagttctctttttcggattacgaaccgcctggagcgttcctttgaggatcaggagtatgccagctctctctaccgccaattgctgtttctggaattcatgatacacctgaaccgcgccgccatcaaaaaccgcgtgaagtttctggacacagaattgtataattctaagattgttgatatcatgcattatattaacggacatcttacggatcatctggacatcgatactcttgcgggcatcttctacatcagtaaatactatatgatgcggcttttcaaggcagagaccggatataccatcggcagctatattacctaccggcgcctgctctttgcccgggagctgatcctggacggcacgcccattacagaagcctgttttgccagcggattccgggattattccacgttttccagagcctacaaatcagaattttctgaggcgccgcgcagcctccttcgccagtagctgaggctgaaccactgcttcggtatggtgacaataaacacaatgccaagcacaatcgcaaaagcaatcttcagcgcttcaatacctctgactgcagcctcccgcaggctgccctgcacgaggttatataccgtatagtagactcccgccccgggaatcaacggaaatatacccggtacaaggaatactgtaatcggacatttcatccacacagcaagcatccgggacatcagcaccaccagcgcagtacccagaaatgtagaagttgctatagaagcgatattctcacttgccagatagcagagccatcccgccatccccgtcagcccgcagcagaagtaaaatctccgcggcacattaaataaaacagagaatgcgattgtcccgagaaaagagcagaacatatttaccagcacaaaccctgtcatagtatcatacctcccgtcagcttattgaagcatcccagcacgaacccgactccgatagcgatatagacaaagacgagaagggcatccacaatccttacgatccctgagataaaatcgctgtttgcaatatcccggatagaattgacaaatgccagccccggaaccaacggcagtatggagcctatgatcagcttgtctatcctcaccgggaagggccacggcatctgaagggcaaacagcgccataatcgtaataagccctccgcccacaatatgaataataatctttgacagcctgtggttctccgcaaaaatcacaaatatatacagaaggcacccaatcacgactgccagcatgctctcccataggttggcctgcagcagatagcaaaaacagccgcttccaatgcctgcggcaaatacccggaaccgtcccctcttgggcggcatcgcctcgatccgacgcagccgctcctttgcctcctccagccccacctttccagccgagatctctcttgacagatcattcacctcggtaacaatccctaaatggaagccggaaatcggaatatgcttcaccttggcatacacttcctgcgtctcatccctggcagtcataaaaataccgttgctcatgacaaaagattccacatccttaatgtgaaatctcctgcagacatgttcaatggtctcctccacccggaaaatctccgccccgttcttcagcagtacccgtcccatattcatggccagatccagcacatcccgcatagcctcctgttccctgcccggcatgcccgctggactgcagactgccccgtctccgcccattctttctccatcatccctgtcagaaccggaattcgctgcgtttatattttttatcacgatctgttctgcatcttttctcatgcttaccttttcatccatgcaaaaacccccaaaacatctatgggatagtatttacaaattgccgaaacaattgcagatatccctgttaaattacttttcgactctaagtaatttattttagcatgctttgagggtaaagtcatctcactttatgtagttattcatttagcaaaaagtcaaaaagtaaccgttcaggaaaccctgaattgtttgcggaaatccttctgttatgcctttgcttttttcttcgactggcctgtcagagtcttgattccgtccacggctagcactgctgccagcacaatcagaagtacgctgatcacgagccggatatagcaccagacaacgccgtccacaccggcaagaattccggcgaagttggacttgatcgtgaggcacagagaagtaatggttacaatcagcataaaggccatcggaatcaggaacatcttattgttcttgcccaccttgccaagccaggtcgcaaccgcgagcaggcccagggcagccagcagctggtttgcagctccgaacagaggccatacatttgcatatccggtcataccaagcgcaatgccaagaacaacggtaataatagttgccacgtatggatttgtcagaaccttcttataacctgtcaccgatttgacctcttcgccaggttccagccagaattcctggaacatatagcgcgcaaggcgtgtagccgtatccagggaggtcaggcagaatgcagaaactgccagcaccagcatagagaatataacattttcagctccctttaaaaacgggatcgtggacgtcatcttggaaatgccggttgcaaatacattcgtaggcactacaagttcccctgcggagtaaaacttccatacatatccgacagcacatagagaaatgattgccagcgcacactcgatcagcataccgccgtatgcgatcgggcgggcatctttctcactgttcagctgtttggcagtggtaccggaaccaaccagtgaatgaaaaccggaaatcgcgccgcaggcgatggtgataaacaatgcgggaaacatatatcccaaagaagttcctgtgggcatcagtgtatctttaaatccggtaaacgcaggaatatccagacttgcatttcccgttattcccgccccgatcacgcctacaaccgcaactgccatcatgaagtaaagcagaaaagagctcaggtagtcacgcggctgcaacaggatccaaaccggtgttaccgatgctattaaaatatagactcccacaataatcatccatgtcttattattcaggtacagcggatgccagttcagtccgattaccatacagataataatggcaatcaccccaatgacggtagaaacgcccagtgatgcatttttgcggtaaaccaggaatccaaaaatcacagagatcacgataaacagaatcgaaatcattgccgtagatgaatttgctgcggaagcggcgtaatccaccgctccggactccgtataagttgccataaatgtatttgcaacaatagatgcaaatgcggcaacaacaaggagtagtgtcaggtaagagaagataatgaatatcttcttagcctttgtccccatagagtcagcaattacttccccgatggactgccctctgtggcggatcgatgcaaataatgcaccgaaatcatggactgcaccgaagaaaatgcctccgatcaatacccataacaataccggcacccatccgaaaacggccgcctgtatcgggccgttaatcgggcccgctcctgcaattgatgagaaatgatgccccatcagtacaggcgcttttgccggacaataatccatcccgtcttcaagctcatgtgccggagtctttcttcccggatccacaccccactgtcctgcaagccatttgccgtaagtaacgtatgcaatgatcagaatcaaaatacctgcaagtaaaattactactgcgttcattgttcacactccttttttcataataatagctttatataaaaaggtcagaagaccttctcatatcctttgattagctccctcgccgcgcggttgccggacacccttctgttctccatgtcaaacacgagcaacctggcctctgcatatccccgcaggccaaatcggtaattcttaaaaaacttaaagtccctgacggccttttccgcctcctttgtcaaacctctctcactgataaacactgccgttatatatgtatacatatgattctcgcaggtacaggcttctccattcctcaccagttcaggctcaatgaatgaaacaatgtgcccgcggaagcgctggatatcctctgctaccagtctgtctatgcacgaaaaaaacgtatgctcaaaacaatctgcccgccacaattcggccttcttcacaaggacatactttgcgcttgtcacattaaaagccgcatacgcttcgtatctgtccccttctatatcatatggacgggtaatatcaaaagccgcttgataagactgcagcagtttttctaaaagttcatgccctttcattgtctattactcctttaggcttttttgctttgatgctctaaagcggcaaaaaaccgcatggtctagtttacaccagcccaagcggttttacaatgatatattttatacttttttaataaattatattaaaatttaatatctatgcgtgtaccctttcccggctcactgtccacggccaccctggctccgtgcagaagcgccccgtgttttacaatagaaagacccagcccggtgccgccgctctctttggagtggcttttgtccacacggtaaaaacgttcaaatatccgttcatggtgctctttcggtataccgatcccggtatccgtaacacatacctttgggccctgaagcgtgttgccggcccagactgacacctgaccatccgctgtattgtatttgattgcattttcacagacattatagatcatttcatctaaaatctggcggataccatgatacaccacaggctctccctccaccacgatgtgcacctttttcgcgtttgcctgtggggaaagacggcttacgatctcccggcagagggcatagaggtccacgtcctctttctcaagctccacagactcctcatccagcttggagagcttgataatatcttctacaagcgtaatcaggcgccgtgcctctttgtatatcctgtcagaaaatttggggacgtcctctgacctcaccattccatttttcatgatctccgcataccccgatatagaggtcagcggtgtctttagttcatgggagacattggcggaaaactccttgcgcatattggaaacggcatccttctccttattctgccggtccatcgcctccaaaagaggggtcatctcctcgtacacagcattgtccagcggatgctccagatccagttcattgatgggcttgatcagccgggcggtctgccattttgccatcagccaggccagaaccagcatgacggcggccagaatgcatatcaccggcagcattctcagagccgtactcaccagtccgtccatcagcttagatacgcgcaatactgtgccgtcatccagaagaagagcgtaataatacatctcttttcccagcgtgccggatacccggatatcctcaccgctgccgctctccagggcgcttgccacctcctgcctggatccgtggttgtccaacgtggattcgtcccgtctggaatcatacgccacggttccgtctgtatcaatccgggtcacccgggtcctcacatccacttcatccatctgttccaggtaggccgggcccgaaatattaatcgcagtcttgatatatctggcctcctgccgcacctctgtcttcaataaagtcaggttctgccggtatatcacaaccgtcagaaccaaataagagatcagcagcgttatggatagcacaaacaccatgctcctctggattttagctctcattcgctcctcctacgcggtatcctacgcccctcacagtctcgataatctcgcccttctctcccagtttctgccgcagcgtccgtacatgtacatctaccgttctggtctcaccgtcaaaatcatagccccatatatcctccagcagctgatccctcgtgagtacaatattctgattcctcatcagtctttccagcagttcgaactccttaagtgtcagtgtaacggcttttccgtccacggtcacctcgtgcttttttacattcacacagacaccgcccacgctcatatcatctttgtccggcgccctacccgtgcgccgcatgacggcttttaccctggacacgagttccatcattccaaatggctttgtcacatagtcatccgcccctgaatccaggccgatgaccttatcatactccgcacccttggctgttaccataatcaccgggatatcctttgtcttggacgagctcttcagcttacggagcagggaaagcccgtcttctcccggcagcataatatcaagcaaaataagctctggcgtatcgaacgccaaagcctccataaaagagccgccttccgcgaagccctgtgccttgagccctgttgtctccagtgtataaatcaccagctcccggatgttgtcgtcatcttctacgcaatatatcatgttgtcactcctttatcaatttttctcccagagccgttccatttctgtggacccctgtgatagaaaattcgacccattcggcgatattggtggcatggtcgccaatacgctccagatactttgtcaccataatcaggtcaaagattctctttccattttcgcctctttctttccggatatagtccacaagttcgtcacggatcgtgtcaaacaaatggtctacggcatcgtcggcctccacaacgttcttggccagttccagatcctttgttacataagccgttacgctgtcccgcaccatcttgctcgctgccgccgccataatgccaatttcctcgatatcggccgcggtattatgcctggaggatatcacaatctccgcaatatctgccgtttggtcgccgatgcgctccatatccgtgatcatcttcagcgccgccgagatcctgcgcagatcctttgccacaggctgctgctgtaaaagaagtttcagacacagtctttcaatatccttctccatctggtcgatctcttcatcggcctccatgatcgctctggcctgttccatatcgcattcctccagcgcttttgtcgcctttgcaatggcagtctcgcacagctctcccatatgagtgagctgctcatccagtaactgtagctgcatgtcaaatctattccgcattttttaaccaaacctccctgtaatatagtcttctgtccgcttatccgcgggtatggagaacaatctctccgtatcattgtattctaccacctcgccaagaaggaaaaatgccgtattgtccgacacacgcaccgcctgctgcatgttatgcgttaccatgacaatagtataatcttttttcagttccatcgcaaggtcttctatttttgatgtggaaatcggatccagcgcggatgtgggttcatccatcagaagaacctccggctccaccgccagcgccctggctatacatagacgctgctgctgcccgccggacatccccagtgcacttttcttcagccggtctttgcattcttcccagatcgccgcgctgcgcagggatttttccacgatatcatccagccgggacttggaatgaatcccgtgggtcctcggcccaaatgcaatgttgtcgtaaatgctcatcggaaacggatttggcttctggaacaccattcccacacgtttgcgaagcaggttcacatccattccccggaatatattttcaccgtccagcaggatctccccttcgatacggcagccctccaccagatcgttcatccggttaatggactttaacaaagtcgatttaccgcagccgctgggcccgataaatgctgtgattttatttgcttctatctccagatttacatccttcagggctttgaaatcttcgtaatacaaatccagatttttgatactaatttttcccatgtctgattcctctctttatgcttttgttaaacgcctggctatcacactggataatgcattgattcccacgacgagaatcaacagaaccactgctgtggcgtaagcctgatccatataaagcccctcgcttgccaggttatacatatgcacggccagagtccttccggagcccatcacgctggatggtatatttgccacggttcctgccgtatacatcagcgccgctgtctctccgacgattctgccgattgcaagaatcacacctgcaaggatgcccggtacggcggacggaagcacgatacggaacacggtcctgagcttccctgccccaaggccgaagctcccttcccggaaagtatccggcaccgctttcagggcttcttccgtcgtgcgcatgatcagcgggagaatcataatagccagtgtaaatgcgcctgccaacagggagaatccccagtccagtgtatttacaaagaacagcattccgaacagtccgtatacgattgacggtatgccggataaagtctctgttgtgaggcggatgatccccataaatctgttgcctcttttcgcatactctaccaggaagattgcagcgaaaatccccaggggcacggcaacgaccagcgacagcagcgtcatggtcaccgtattcaccagcgccggcatcaaagatgcattgtctgaagtgtaggtaaaagagaataaagaaggcttaatataggggacaccgtgcaccaatatataaataatcagaaaaataagtactgtaaaagtaacgacagcgcccagcagaaccagaagcatcatgagaaaggaacccggatgatgcagataagttttcattttttgacggaatgttgtttgattactcacggccggacctcctatttaatagtgccacactgaagttgataaccaggataaatacaaacagaaccacacccgttgcaatcagcgcttctctgtgtaactctgcggcataccccatctcaatcacgatattagctgtcagagtcctgacacccttcaggaggcctgcaggcattctggcctgattaccggccaccatgataacggccatcgtctctccgattgcacggccaactcccaggacaatccctgcaattaccccggattttgccgccggcatgatcacccggaatatgcttctttcatgggtggcccccagcgccagcgcgccttcataatactgctgcggcactgaacggatggcagactctgtcacaccgataatcgtaggcagaatcatcattcccagaaggatagaagctgttaaaataccgctgccgtttccgctgctttttgtcagtcccatttcccgccatgttcttccaagttctcttacccagggaaccaggacaaccagtccgaaaaatccatatacaacagaagggatgccggccagaagttctgtggccgccttcagcggccggtaaatctttttcggacagtacattgccataaatacggaggtcagaatccctatgggcacgcccacaatgattgctcctgccgtcacataaatactccccacgatcatgggaaggatgccgtatatatcattattcggcttccacatttccccggtgataaattttacaaatccgatctctttcattgcagggactccatttgcaaataaaaagacacaaatgagagctaccgccagcaccgaagcacaggcggcaatgaagaatactccctgcatgaatttctcattccatgcttttgatttcatcgattcaattccctcttcctggtcaggtttctgagctttattcaatcacttcatcccaggtggctgcctcgccggtatagattgcttttacctggtcactgctcagctcatctactgtgctgtttttgtttacaatcactgcaattccgtctgttgcaatcacagtcgcctgaagcccctctgccagttccgtatctttcagctctctggatgccattccgatatcatagcttccgtcaatcgcagacgtcatacctgtcgtagaatccgttgtctgaagttcgatctccgcatttgcattgacagccttgtatgcctcgatcagcttttccattaccggagagatggaagatgaaccgccgactaccgcttttcctgacggacttgtaccctcaaaaggtttcacatcatccactgcaatatagtgattttcttctacaacggcctgcccttcctcgctcataatgaagttcataaagtcttttgccacttcattgtccaggttttccttggttgcaatgttaaacggtctggataccttatatgtaccggattttacattttcagcggttgcctctgcaccgtcgatttttaaggccttcacactgtcgtccagtgatccgagtgaaatatatccgatcgcgtactcgtcgcctgctactgtcgtcatcataacggaagtgctgtttgtaatctgcgcctcctccgttgtcatatcaaccttttcatcgccatttttttcctcgattccgaacagctcgataaacgcaccccttgtaccagaaccatcctcacgggatacaattgtaatatcataggagctgtcccaggaagcactttcctgctctgtttttgtatctgcatttgcatcggcagtatctcccgccttactgtcgctgccgcatcctgttgccgcaactgccagcatactaaccatagataaaactgcaataaactttttcattctcatttcacaattctcctttacattttaaaataatcttcgggcaaatacccgacatttacttgaaccattttcttcacaatgcaatcatataaaatcaatgtaaagtttgaaatcatcataatgttaaatccttgttaagtgcatgacagcaaaaaatatttattcagtgaacgaatttcgctgacatttagcgcgttgtattatataataaaggatagtaataaacaaaacatctgagaaataacaattgaagatactcaaataacagacagcagtctttctcaatttaactttaaggagaaaagtattatgggattattcagcagcagcaataaagatccagaggcagatcttattatgttagatggaataccgtccgtcagcaggggaacaacagtgacactgggtatatccggacaagttctgacagtaaaagacaggggcagtgatacatcattatatactctgccagcgagcagaattaaaaatatctacatgggttcggaaaaccagattgtaaataaaaaaataaatgttcacggtgaaatagtggttcatgggatagtaatagaagctctccgggatctgattggtgatggtgataaacaccgttactttatgataatcttttacgatttcaaacagacacttcttttcgagattacaaacgaagccaagaccttaaggctgtataacaaattaaatcccatgatatccaaataagccatacaatagcaaaatataacaaacagccttgtcttcaaagggattaatagtaaaataaaagaagtgtgcggacatgcaacttctgtcttctccccctttgtcagctgggcagagcactggaaaacacggagttgttaatccgatgtttttaatcactcccagctgaatataaagggacaatattttagagtttaacaaatattttatccactgcgccatagtctttcgatttatgggaacaatacacaataaaaaagatacttatccccactcctgcgaatcctctcactgaagagccttcccggttctcatcgtccacgatactacagcccctgttcaatccgataagcacccctgtactgcgccggagtcattttttctttttctctgaagcggcgtatgaaatggcttgtattgcaaaagcccagcatttccgagatttcgtcgaccggcagtcctgtctgcatcagcatctgcctgcctttcctcagtcttctgttcattacgaattcctggggcgtcatccggtaaatggccttgaactgtttgataaaatagggaaggctgatcccgcagacgtcagccagctggctgtttgtaatcctatcccttagatgggcatctatgtaggcctctacgcgggaaaaatttgcttttacatcctgggaaatctcggccattgcgtaacgcctctcattttttaaaatctccagaagcaggcggtagatctccagggagacattctggcgctcatcaatcattagtttctgctgtaatattcccaatgctgcagatgcatctgaaaatatcattccttcgatcacagggccctgtgtgtctacaatgtggcgcgtcagccttctgctgtcacccccgtagaattctacccacgacattcccaatggctccgcctcatcgcttccatatgaatgttcttcccctgcaggaagtacaattacttggtttttacccagctcgtaagtattgcccctgaaagtcagccttccctttcccgaaaaaatgcagaacacctcgcagtagctcatagtactgtcccgttctacaaagaacaggctgggtactcgggattcaattcccgttctgttgacacaataataaatactgtcctcgatctccttgaacggcgatatataataatagtcatgaaaatctatatcgccgttacatacaaatatatttgcaaaaggggcgtcttttatatattccacagcctcatctcctgtctttggctcattttaatttttgtactatcttattataaataataatgaaaatcacgtcaattttttactgagaaataatactctcatactatttcaatattttccggtgccttgtataccgcctggattttttttaatattagtttaaaggagttccgtactctaacgaaaggagatttaaaaatgacaggaaaagaacgttttcttgctgccgcagcaaggcagcctttagacagaccacccatatggatgagtgcgccaatcggagaggaaatgaatatcctctgccggtatttcggcgtatccaactggcacgaactgcaggtcaaagcaggcgatgatgtgtatgcttttgacattccttatgattccggctatgccaccagcatagcagccgcattcgactggtatagaaatggctcgaatgtagatccggaccaccggaccctgacggccgacggctgttttaaagctgcgcaggagatatcggatctggattttttcgactggccggacccaagaaagtatattgatgcggaggaagtaaagcgccgctgtgcaatggcgccggaaggacgcgccacccttgcacaggtatggagcgcacatttccaggatacatgcgccgcattcggcatggagaccgcgctgatgaatatggtctgcaatccggagatttatatggctgtagacgataaaattgtggatttctacttgaaagccaatgaagtggtttatgagtccacaaagggaatgctggatgccattataattgccaatgactttgggagccagcaagggcttatgctgtcccgggaaatgattcatgattttgttatgccgggagcgaaaaagattattgagcaggctcacagctatggagtcaaggtcatctatcactcctgcggagccatattcgacgctatgccggaactcattgaagcgggagccgattttatccatccgcttcaggctacggccgtcggaatggatccgcgccggattaaagatgcctatggggaaagcgtctctttctgcggtggaatagatatacaggaattgcttccaaacggcacccctgaggaagtaagggctaaggtacgacaacttcgtgaaatctttccaaccggactggttctctcaccgagccagggaacgattctcgatgatgttccgccggaaaatatagcggcaatgctggacgaagcactgaaaccttaaacatagataacagaaggcccggcgtagttttaccgggcctttttgaggaaaaaagcgggcaagcccacatgggcttcccaccccctcactcatgaggggcttgcacacaccgctttgcggctatataccttatcgcggcgtgtgcatcctcccagaggaatttcctatatcataaaaagagtaacaggtcagacatgcctgaactgttactttaaaggactgccggctcaccgcattcagcggttcgcgcagcagtccctgtggattaattagctactgtaagtacttcttctgcaatatttctggaatggtcagagatacgttccagacacacaagtgcgtccagatatacaattcccgcatccgtattgcactggttcgtggcaagacgtttcatatgctcgctgcgcaggcggatctccagatcatctgcctgactctccttctctatcaccttcattgccttctctttgctgttttcctcaaatgcctcaattgcatatacatagctatcgatacagacattgatcatctctctgagctcagcagtgccgatttcggaaaattctgcctttctttcctgcagtgtctcagcaaattctgaaatattttcgcagtaatcactgatacgctcaatatctgacagggtctgcaggatactcgcaatgtgctggtgctctttctcattaatggacagcgcgctgatcttgatgacataatccgtgatgccgctgcacagcctgtccaccacattttcttcctctttaatatccagaatctcctggtagtcttttgtaaacataacattcctggacttttccaatgtcccctttacgatggttcccatacggacaacctcgctgactgctgactgcagtgcaatccctggtgtctccaggattctgtcgtccaaaagtacacggctctcgtccacctctctgtcgtcttccttttccatcttcttggccagtttaatgatccagtccgaaaccgggaagagaaggacagttgttccaatattaaagatggtatgcaccgtactgatctctgtctgtgtaataatgccgcctcccgcattcgggtagatcaccttgaaaaatatgatcgcaacaacactgaagagcacggttcctataatattaaataaaaggtgcataaccgccgctgtcttcgccgtctttttggcaccgatactggacatgatagctgtgacacaggtaccgatgttctgtcccatgataatgtaaaccgcagcattgaacggaaccagccccgccgccgcgagactctgcagaataccaacagaggcggaagaactttggataatcgccgtaaccaccgctcctgcaataattccaagaaacggattatgtccaagcgttacaaagatattacggaatccctctgattcctgaagcggagatactgccgatgacatcgtcgtgatgccgacaaacaacagaccaaatcctatgataatgctggagacatcttttgtcgaacgccttgtccctgtcagcatcacgatcacaccaagcatgattgcgatcggcgccagatttcccggacttaaaaacttcgcccactccacactggatacaagccagccggtaacggtcgtaccgatattggcacccataatcactcccattgcctgggtcagattcataatccccgcattcacaaaaccgacaaccatgaccgttgtcgctgaagagctctgaataacggccgtaataaaagcaccgagcagaacaccaaaaaacttattctttgtcagtgcttccaataatgtcttcatcttactgccggcggcattctcaagcccctgggccataatctgcattccatatataaacatgccaaggcccccgacaaaagggataataatgcttacgtaattcatacgtttcctcctaaaaatatactgctattctaaattttcccgcattattacgataacattatcatttacaaaaaacaacataattttacatatattttatatggattttattttttcatccgcggctcaaaaataaaggatgcaatatacccaaaaatcaaagctgcagagattccaacggcgcttgccttgaaacctcccataaatactcccagaaacccatttttatctaccgcttctttcacaccctgccagagaacgtttccaaaaccaagcagcggaacgcttgcccctgcccccgcaaacttctggaacggctcataaatgtttaagaagcccagaacagcaccggtacagacgagaagaaccataatccttccgggcataagttttgtgcggtccagcagaatctgcaccactgcacaaataataccgcctattaaaaatgcttttaaataatccataagaacctcctttgagggcgaaatttcttatgttacgcccctgctacttttaaactaacagtgttccagcacaatggcatgggcaatgccgggcacgctggctccctcgttaaaactgacggtggacatcagagctcccgtaggaacaaacagaatcctcttccactctccttttttcacctttggcagtatataggccgccagagtgactgccgcacagccgcagccgcttccccccgcatgggtgtcctgggcctgctggtcatagattgtcatgccgcagtccatatgttttgtcttaatatcataaccttttccctgcatcaggtcgaacagaatatcctgccccacgtaacccagatctccggttatgattctgtcgtaatcttccacttttctgccaaaatcctgcaggttctgtgcaatggtgtctgccgcagccggcgccatacatgcacccatattctgggaatcctttagcccataatccacaattttacctacggttaccccgctgatgcggatatggcttttttcggtgcccaccagaaatgcgccgctccctgtcacagtccaatgcgcggataatggccgttggttcgcataccccagaggaaaacggaattccttttccgcgctcccgaaatggctggatgtgacagccagcatatagtccccataccctgctgcgacgctcatcgcgctgagtgccagcgcttctcctgaagtggaacaagctccgtacagtccgaacatgggaatctgtagcgcctcaacccccatagaagtcgcaattccctgtcgcagaaggtcgcctccaaacagatagcgcacattttccggcggtacatgtgctttacccaacgcaagtacgcacgcctctttctgcatattgctctctgcttcttcccaggtctttgctccgaaaagatcatcctggtttgtcatatcaaataattttgcaagcggcccttccgcttccttacttccgactacggagccgctgctgataagataaggagattctccaaagccgatgctctggctgccttttacctgattcatctctttccctcgtttccatttataatttgcttggatttttatgattagtatgccagggtttttccatattattcattcggacgcttaccatgagccgggagatgctgcgggaagtgcctgtcctgttggaaatacagcccgctgtgctaagcagcagtaagaggaaatccgcagaatcagccggaaccaaacacattcaccgcttaatctgatgattaagcgcctcaggtgttttaaaaagctgctttgaaagcagcttttttccggctgattctgcggatttcctctaactgctgctaagctcgctcatatgcatttccaacaggacaggcacttcccgcagcatctcccggctcacggtaagctggtgcatccggtcggaagggatgggctcggattttggcggcactgaccggagctgcggatgggataggaatgggggcttttctagctgcggttagttttttaaatattttattgacaaaagtatactttttgtatatagtgtacttatacaataagtacagttaagtacgtgtttggctgcactgtaattctaaactaaataagtggttaatgattagataatgttctatgggaaggagggattacatttggatattattctcagcagcagcggggggaagcctatctatgagcagattacatcccagattaaagggatgattatgagcggccagctgaaggccggggatgccctgccttctatgcgtatgcttgctaagagcctgcacatcagcgttatcaccgcacagcatgcttacgaagatctccagagggatggatttatagaaactatccccgggaaaggcactttcgtctctgcccggaacaaagactttattagagaagaacagctgcggattgcggaagaaaagctcaaagaagctgccgggatagcaaggtgcaacggtatcccgctgtcacagctcattaatattcttgaattattttacaaggaggactgatttatggaatattttacggatcatatattaagcgtaagccatttaacgaaaacatataaggatttcaaactggatgatgtgtcttttacgattcccagagggatgatcgtcggtctgatcggggagaacggtgccggcaaatcaactacaatctccgccgtcctgaatatgatctccattgacagcggtgatatacgtgtattagatatggattttagaaaacaggagcgtgagatcaagcagaaagtcggagccgttctggatgaactgcaccaggttccgcacctatactgccgcgatattgactccattatgaaacgttcttatacacactgggacagcagtctttttaaagaatatttggatagattccaccttcccgcagacaaacaaataaaggaattatcaaagggtatgaacgttaagctgaacttcgcaattgctttatcacacaatcccgagtttttgattctggatgaggcaacatccggactggatccggtgatgagagatgaaatcctggatcttcttcaggactttgtgctggatgaaaatcattccgtcctgatctcatcacatatcacgagtgacctggataaaatagcggattacatcatcttcatgcatgaaggcagaattcgattcatgaagtcaaaagaagaaattgacaaccaatacggggtgttgaactgcagcagcagctttttcgaagcgctttcgccggatgattatcaggcttatataaaaggcgattattccgtacaggttctggtccgcagcaagcaggagctgctgtcccatttttcggatctggtcatcgaacgcgcaaccgttgaagatattatgcttttttatattaagggggttatcacatgtcaggattagtttacagagatctgcttacgttttatagaaagaatacaaaagtaacctatattatggaagccgtatactttttatttttcctgctcgtgctgagaaatatttacggtgccattactttcctggtgattgcctctccaatcagcatgtcagggttaccggcaacgatgaaggatctggataccaattacaagggaatgatgtctgcaaggctcatgccttatacacagagggatatcgttacagcgcggtttcaggccgcattttcctgccatctcctgtacctggccgaaatgctcctgttctgtatcctgcatcacgctatcacaggcagcatctcctggaagacttacgctcttttatttttaggcggctggctgagcgccgtatttatcaccagtgtcaatctattatccagcttcatcactggcctgaacgcagcctccatcatttatctgctcacggtaattctgcccgtcggactttttctgctcatcatgctgaccgatctgtatgatattataataccgttttttacaggacagcatccattaatcttctggattcttgccgttttgctggatatcattatggttactgtaagttatctggtttccgtaaaaagatttacaaaacaaagagaaaaactataaaaaatagtaaggcgcgaaataaccttgccaactattttttatgcatcgcacgtaagcggccgaaatacggccacttacgtgctcgcagctacaaaaaccattttgctggtatattctatcttattttccaaatactaatcccaatctagtgtttaaaggagaaacagatatggataaagtagaaaaaatgaagcaggaaaagcagtaccaggattatgttaaacaaaaaactcctgttcataatgtttatgttaatatggcaaaagcctttgtcacgggaggaatcatctgcacggtcgggcagttcatctacaattactgtgaacttcagagcttatccaaggacgagtgcggcagctggacttccctgctgctggttctgctcagcgttatacttaccggaatcaatatctatcccaaaatcgcaaaatggggcggagccggagccctggttcctatcacaggattcgccaactctgttgcatcacctgctattgaatataaaaaagaagggcaggtctttgggattgggtgtaagatctttaccatcgcggggccagtgatactttatgggatattcacgagctgggctttggggattatttattggctgtttaaggttatttagagtgttggacgcctgtgcggagggtagagagacggggcaggggcgggaaacttatgggggagttccggagacgggccgtttgcctagtctcactagataaaaaccacatcggattgggaggcaccagcggcattcaccgcgcaattctgatgaattgcacggctcaggctgctttaaactctgcttcggaagcagagtttagcctcccaattcgatgtggtttttatctagtgagcctacggtacactcaacagaggatgtgtttaaaatccgttaattactggcgattgcttgtgtttcttgcttcgaaagtgaactggtcagtaatattttttctacttctgttatgtctggcattccgatctgggctccgcatttttgtacggagaggcctgccgctatgttggcgaattctaatgcctggagttcttgcatttttttggacaggcctacgcagaaggctccgtttaaggtgtctcccgctccagttgtgtcttttacttctacttttatggcggggagggttatgattcctttttcatttgtgttgatgctgactcctttttctccccgggtgatgatcagtttgccgggataacggggcagcaggtttgccatgtctgccgcttcttccccccatattacttgcgcttcgtgctcgtttggggtcaggtatgtggccatttccaggagttccgggtttagttttctggccggggctggattccagactatggttttgttgtgcttgtggcataggcgtattacataatctatggtttcttcgggtatttcgttttgaaggacgataatgtctgcttttagtatttccctgtggttgtttttggcatactctttgctgacataattgttcgccccggctatgatgatgattgtgttgtctttttctccgaccgttatgaatgcctggcctgtggggatttcttctaatatatttatgtgttctgtgtttacgccatattgagccatgtttttgatgagttttttcccggccgtatcatttcccacgcaaccgaacatggtgacgcgcgctcccagcttcgccattgcaacagcctggtttgcgccttttcctcccggctggtattcgatgctgctgccgggaatcgtttctcctttcagtgggatccggtccgcatgtataatcatatccatattcatggttccaactacagctatttccatatttttatcttctcccgtttcgttatattcatggttctgctttaactttttttgcgcctcaatctttttaagttctgtgcctaagtattttaaaataggttccttactttgtcacagttttggctaatctgaactgttacttttattttgtcagtttttccactaaatccgctaacagcttgtcgcggttgatatggtatacgtatttgtaaaaatgcccttctctgcaaatggaatatctgtggtcatattcgggaatgggcgcgtattcgagcctgtcgtacatcaattcttttccaagcagccatcctacggctgtcacatcccatatcgggcggctccataccgccccggctccgcatgctgcggcttccttcgccgtatagtctgccaagtagttgcacagcccgttttttcctttgatatatgcttccagttccggtccgctgacggtaaaagcggagacgactcccatgcaggggagctgtaccaggggaaccccgcaaccaaatacaagccttgcccccgcgatgtcctgatatagattaaattccttgttatccggccactccagggcattgccccccagccatacgatgacaatgcggttgacaatttccgggttcatcaaaatggcggaggcgatattggttatggcggctatggcgatcacatacagcggattgtcttccgaatattccatggcgcgctttgccaggtctttcgccgcatctgagataaccggcgttttctcatccggcagataggcttctgaacctttgtaaatgctgccgaacatcttttcttgtcccatcagttgcaaaatatgccggatctcctcatagcttttctccataccatcttttgggctcttcgatttgctattggtaaatggggccgaatagattgcctttacacgaatcttatcatccgatttcagcatgtaagccagtgcgtactggtcgtcgatttcattataggtatccgtatccagcactgtatcaactattccgtccggtctttccagcctttttatgattcggatcttctgtgcgctctgatcctcactttttttcgaatgccccacaaattccagccattcttctctcaatttttcatcagtcatttcttatcctccaatttatggttgtacgcagcccaacataataacgctgctgctttccggcattaacgcatttctccttattctttatgccacatttctccttatcccttaataccgccggaggtgatcccctggacatagtatttctggaaaggcaggaacaatacaagcggaatcaaagctgatacgacggatgccgcgtacaggcaggaccacagcgtgacgtgttccgcagtgaagtcggagagtgcaacctgtatcaaacggatttcttttctgtgcgcgaccagcagcggccacaaaaatgaattccactggttaataaaagccataagcgccgctgttacaagaacaggcttagacagcggaagtataatccgcgcataaatctgcatccagcttgcgccatctattctggcagcctcaagaaatccggctgaaatattcttaaaaaactgtacaaataaaaataatacgaatccgtcaattaccgtgggaatgatcaggcccttatatgtatcaacccaatgaaactgatctactactttgtaaagcggaattgcaatcgactcaaaaggtatcataaaggaaagcagtacaagcccataaaacaattttttccctttaaactgaaagaaggcaaatccatatgccgccagagagttcagcaggcagcccaggaacatgattgcaccggaaacaattaaagtatttaaaataggacgccaaaattgaaattgtgtgaaaatttctttatacgcatctaatgtaaattcaaccggcacgaatgtatgccattgaaatggaaatgcatactggtagatttccgtatcagaacgaaatgaggatgaaaatgtccagactagcggaaaaactgccacaaaagccaatagtattaataaaataatactcaccgcccggcctgccctgtgcttattcttcatagatcattcctccttgtttaagaatttgaactgcaccgctacaatgattcccacgatcaacagcagtacggacatggatgccgccgccctcgccgaatccccgtaaataaatgcagatttatagacttcatacataagcacattggtcgaattctgcgggccgccctttgtaatcatgtacataggagcaaacagcaataagttggaggttgtatcattgatcacaacaaatgccattgtgcgcttcagcattggaagcataatgtgaaatacagattgccagtaggacgccccgtcgatcttcgcggattcatatacagtctcgtcaatgtctttgatcccggccagaagaaacatcatcaggtatccgcagcctttccagatacacagcatcataatgctggcaagggcctgcttattacttgtaaaaaactgctgcggctccatccccaatttcatcagtatgctgtttacaacgccatttgtgggattcagcatcatattccacataatacaggccactgtgattgaaactgtaacaggcagataatagattgtccgaaaggcccctatcccccgaagtctctggctgaccagcagcgccatgccgaaggaaatcacgatctgcacagggatgaggatgatgcagaatttaaaggtagtcagaatggaattccagaaattccggtctccgaaaatccgcgcataattcccggtagagaaaccgtcattgccctgaaagctagaccatatattcagaacaatagggtatagtttaaatatgagaatcagaataattgcgggtgcaatgaccaggtaaggaaagatcatggttctcttccttggtagatgtctttttggatgcatagttcctccttcttctcagccaggcctgtccggttccgaccgtccaggcccggcatgaatgtctgatccgtaagtcctatttataagcctccatcaggtaattcgcctgttcaatacagcttcccagggcttccaccggatccgcgccattttcaatatcgaccagtgtcgcgtttaatacggaattatactcggagtatgcaggagtgatcggacgcgcaaccgccgtattagctgcctcgtatgccgcaatacgctgaacgctcttcggaaattcttcatacttgggatcgctgatcacctgatccacagcagcagtccgggcaggaacatccccgtttgcctccagccacatatcgtttccctctccaaggctcatatacttgataaattccgctgccgcttccgtctgtttactataagcagatacgccaaagtgccaggagcccgtaggcgtcgctaccttatcctcatatccctcaaatgccggacagtatgtatacccccactcaaatccatccgcaaattcactgtttgcaacccagcttccgccaatcaggaagatcgttttcccggaagtaaacgtagactggttttctgtagatgtaagacctcgtggagccaggccgctctcgtataaatcatggacaaaagtcattgctttaatccagccctccgtattgatgatgccgtcaacggaaagcccgtcgtcgccaatcgctttttcgccgagactgttgggcagcgccagcatctgatagccctcattcgcctgctcaaagacaatgccgttaatcccctttgcgccgtccggatcgactttcccgaccactgactccgctgtttttacgagttcttcccatgtcaaacggttattgggatccatttcaggtattgcgatccccgcttcctcaagaaatgttttattatagtatagaatctgtgaagaagtattcatcggcgggctgtaaaacttgccgtcccaggaaccggagttgactgacgccggaacaaattcgtttatttcttcttctgagaaataatcattcagaggcacaatgtagccttttgccgcatatgcggctgtcataggatcatccacgccgataatatctacggtatcgctcttggcattcatcttcgcttccattgctggaaaatagttattatgctcatagcactcaaattcaactttgactccggtctcttcgtaatacttgtctacaatgggctgtaatttgtcctcccattgtcctccgccggtaagcatcatattgagtacaacgcctccttctttttctccttcggctttggaactactgtccccgtccccctctcttttagaagaacaagccgttaaggtacataccataacaagtgcaataattgacatgattcgttttttcattctaattcctcctctaatttactgctttttggttgattctgcgctgccaggctaaatctcaatgcggcggtatgctaacgcagcgatacatcatacagggccatgatattttctatgggcgtgtcattctgaagataatgtgcggaagccataatatacccaccattttttcccaaaactgaatttacgcgcctgatttcttctttcacctcctccacacttcctgccggcaatatcttctgcgtatctatcgctccgtgaaaacataaggtatctccccatttctcttttatgagctgaagatccattcctttggcgctggtttgaatcggattgagtatgtcaatcggaagcctgctcagactgccgatctgcgtaatcaccgaaccgcatgaatgatataatatttttttcccataacctttgattaacgcattgagcttgcgatggtaagggtatataaattcttccagcatttccgatgatacaatcagggaatcctgcgcggcaatatcgtcataagtatagacaatatcaattttgtcccctgcatattccatagcatatttgatatagtcacaccaatagcagcagaagcggtccatgatataatggacaatttcgggggtgagtatcatgtccatcagaagctgctcaaatccgcgcaacgcccagacatattcaaaaatcccccctgcatgcagttttatcacccgtttttcatgcagatctccaatcttttctgaaaatccgcgccagtcaaaggccccgggatccggccatttatcatatctctccaaatcttctgcggatgctgcaaggcctaatgggctggatgcgtactcttcgtacgaacaataatcgttttttaccacacggcggtgaacccccatatggtcataccagcttccgtcagccaggatttttggcttagggagcgtggaatccggaaatacaaactgcagatccacctgaagcagatcgtagagttcctgctccctggctgcaccaaaataccggagcagcttttgcaacgtatccggctcagcccagaaatccacaggacatctgtcgggctgttggtgtgccagagcggcaaatacacgttctctgcttgtcaaactatcacctcctcatatatttcgaatagatttcatcttcatagatgtccacggacttacggtcaggaagcgccggctggactccgtatctggttacgctcagtcccgatgcataaacggcgcatcctatggactgaatgatatttttcccctcgcttagataaaccgccagtgcgctgataaaagaatctgctcctcctgtcgtatccaccgcttcaaacccggttccctcaaaatacatggagtactccaaattcctgaaataacatcctctggtcccaatgtgacgattacattaccaacgccttttctcagtaaaatctccgccttctcctccaggctctctcctcggggcacaaaaacatttaactcatgttcgttcggaacaaaataggaaatatccgggagcagctcgtccttaattttctccacggcagaaggctttaaaataacctgtgtgtcatttcgtctgcagaatttgatcgtgtattccgctatgtctccgggaatttcaagagacaacagacagtacgcagcgctatcgaacaggtatttaaaccggttgatatggaggatgctcagatttctgttggctcccggatataccacgatcgtactttcgccgctgcgctccacattgatgtatgccttaccgctgggaagggaatgatcgaaaagcacgccatccatgtgcacatggttttccgtaaggctcgtgtagagctgtttcccgtccatatcatttcccaggcagccgatcatataggcctgtccgcccagctttccgactcccacagcctgattgcctcctttccccccgggaaatacatacaccctctccgcaatctgcgtttcaccattcacgggaattctggagacttcaatcgtaacatccatattcatgcttcccactaccacaatcttttctcccagcttagcctgtgcgggctccgcaatgctcccgcgctctgttatggcgggcggaaatcttttcatcacctcaatctgcttttcactctgaatcatttctatcagacacgcggcagcttcccccgccacattgttactcggaagcttcaccgctgttattccatatccaagcatctctagcatccttccatccccgatggagattattgataattcttccggaatcgcagttctgccccgctctaatactttacagacagagaaagtgatctcctgggagccgcagataatcgcagtcacattctcactcaggcattggcttactccatacttttcgatgtcctcaatcgtatcgctttcataagaccagatcggctgcacgggaaaattgttattctgcatagccagcttataaccatcccatatgcttttgtcttgttttaacacaatacaggctattttctggtgtccggcttttataagcctgtctgccgcaattcttcctacctccgagagccggtaatagaatgtcgctttctgcctttcatcaaacccctttgtctggcagatatacacggaagcattctcaaattttgtttctgtaaaacactgattcgtatccagcagaattcccgctatttttctccgggccatctcagctatcctctgtttcatctcctttgattcatctacatagctgacaaccagactatagcccatatcgcgcgccgtcttttctgcgctcatgatcagttcttcccgttcccgattattctttctgaccagaaaaccaatcagatgatttttcagcccttccttttcccgatattttgaatacgggatataattttcttcttcaattacctttaacactttcttcttcgtctcttcaccgatatctttgtccttgccattcatcactttcgatactgtagatgctgaaaccccggcaagttttgcaatatcatttatattcatttccctccctcctctatttcgtttactttcaagaaatttttttactaaaatgtttttgttacttaactttaacattttgttctttttatttcaatattccatctttacgaaagtattttccgacattttcaacaaaatgtataggtttcgaaaattctttcgtacaatagtttctggtaaaattgacatgaaaaaaggagggaaaaccaggccgccctggtttctctccttttttctgttccggcttactgccgtttacttttttatccccctgtatcagtttcctgctatcgcttctcccgttatctcatttacgcgcaccgcccgccgctaccgctcctcgcggaaatagtttaggccgcagctctttggctgtgcatgctctttgctctggcgcatgcttgtgactaccagaaccacgattgttgccacatatggcagcatgtcataaatctgtgccgggagtcccgggatgtttacatacatacgcatgattgtcaggcctccgaatatcagtgcaactaatattccttttgcaggtctccatgttgcgaaaattacaagagcaacagcgagccagccgtagccgctgacacatccgtgtacccagacgccggatgtggtgaccatactcatgtacataccgccgatcccacatattccaccgcccactacggttgcaatatacttgtattttgtaatattgattcccgccgcatcggcagtagccggatcttccccgattgccctaaggttcaagcccacacgggatttgttaaagaaccatgccataaatatggcgaggatcactgcaaaatataccagccagttatattcgaataacagcttgcctataatcgggatatcagacagcaccggtatatgcagccttgaaaaagctgcttttgtggtaccgcttaccgctacatatccaccggccttttgtccgatatattccccgaaaaagttgccgaaacctgtcccgaagatggtcagcgtcagaccggttacgttctggttcgcacgcagagaaatggtgaggaacgcgtagatcagcgctccaaaggctcccgctacaaatgacaccagaagcgcaatcaatgcagataccgtcccgctgacactgccgccggattttgccacggcctgttcgtaataataagagcctgccagacccgtgatcgcccccatgaacatcatgccttccacaccaaggttcatatttcctgatttttcagtcaggatttcccccagcgcccccagcagcagcggtgtacctgccagtactgccgcaatgaataaactgtttaatgtactaagcatgctgttcctcctttcctctgaaaatcagacggtatgtaataaagaactcgcaaccaagcatgaagaaaaggatgattccaatcaacaggtctgaagccgaagccggtatcttaaaattcgtctgaatggtattggatcccctctcaagcatggcgataaatacggaaaccaccagcattccaaaggggttcatctttgccagccatgctaccgtgatcgcagtaaagccgacaccgcctgcagttccttccgttatcgtataatctgcgcccgcaaactggagcattcctacgaggccgcacattgcaccggataaaaacatggtgcggataaaaactttgctgacgttgattcccgcatatctcgccgtgttattgctctgtcccacaacagcaatctcatagccctgcttcgtcttattgaaatagatgaatgcaagtacaaccagaaccagcgccagaatccagccccagtggacgcccagtacctttttcagccttgcgccctgtaccagcatggcaatcttcgggaaactgcttcccggcgctttccacggaccattcatcagatatttgataaatgcaagtgcgatatagttcagcatcagggtaaacagtgtctcattggttccccattttgccttacagactgccggaagcagaccatacaggccgccagccgccatacctgccaaaagcatcaggattacaagcggaatctttgggaagatatgcgcggtgaataatccaaacgcacccgctgcaactgcccccacaaggatctgcccctctgccccgatattccagaacttcattttaaacgcaaaggagataccgatcgccgtgatcaaaagcggaaccgcgagttttacggtctcatggattacggttctggaaccccaggatccgattaccatagccttatatacagccagcgggttatgtccgagaactaggattaaaagccccccggtcacaagcgacagaagaaaagcggccgcacggattccccaggccttctgctgtgaaatagaacctcttttcaccatacggatcagtggttcttttacctgtgtctgcttactgctcatacccctgcctcctcttttgtagtctcatccttattttcaccggcggcatgtccgacggcattttcctggtcactgctcttcgggccgtttttctcatcccccacatggatcatcatcaggccgatatcttccttcgtcaccgtgcgcggatctacaataccgctcacctttcctccgcagagaaccatgatgcggtcggagagttccatcagcacatccaggtcttctccgataaatataacagccaccccctttttcttctgttcgttcagcaggtcatagatccgataggaagagttgatgtccagcccccgcaccggatatgccacaatcaatacggacgggctcagggcaatctccctgcccagcagtaccttctggacgtttcctcccgaaagccttcccacaggcgtctctactccgggcgttacaatctccagctcctcaatgagctgttcagccactgcctttggtgttttccgatccacaaaaaggccttttttatctttgtagcttcgaagcattacgttgtctgtcatatccatacccgcaaccagccccataccgagcctgtcttcaggaacgaaggccatcgaaatgcctttttttacaatctcgtcgggcttgagtcccagaatccgctctttgatcggctctccgttatgttcgcctgcgtagagcaccgagccgccgatggcaggatacaggcctgcgatcgcctcacagagttctttttggccgcttcctgcaatcccggcaacccccagtatctcacctccatacgccgagaaagagacattgtccagcgccttgacaccctcaccattcaggcaggtcaggtcaatgacctgaagacgctcaatgctccgctcctgctttggcctgtcaatctccagactgaccggccgccccaccatcatctccgtcagctctgcctggtttgtctttgctgtctcaacagcacctatgtattcccccttgcgaagtatcgccacacggtcggatatcgccagtacctcatgcagcttatgcgtaataatgatgatggatttgccatcctttttcatattacgcagcaccgcgaaaagcttctccgtctcctgcggcgtcagtactgccgtaggttcatccagaatcaggatatctgcccctctgtacaaaaccttcaggatttcaaccgtctgtttctctgagacggccatgttgtaaatcttcttgccaggatcgatctcaaacccatatctggatgcaatctccgctacctttttatttacttctttccggttcagcaccgccttcccgtcaagtcccagcacgatgttttccgcggccgtcagaacatctaccagtttaaaatgctggtggatcattccgattcccagtccaaacgcatccctcggcgaacggattgtcaccggtgtgccgtggatgctgatttccccgtggtccgggaaataaatgcccgaaagcatattcatcagcgtcgtcttaccgctcccattttcaccaaggagcgccagtatctctccgtttttcagctccaggtcaacatccttgttggcaacgacctttccaaatgttttggtgacatgatgcattttcacagcatattctgtagtctcgcccaagtcttcaccctccttttactcttcctgtctttcttctcttccttttcagtctcctgttcgggtacaccgcaatacacgtccctgcaatgacatgcattacggaatgcccgaaaaggcctctctccaaaaacagagccgtcatacaacggctctgtcaatgaacttatccctgaatgaatcgataatgctgcttttcacaccattcgggtgctcttagtaactcgattattcaaccacattgcatccttcgacgatataacaccaggatggtgcagaagcttcttcctgctcgtgatagtaatccccttcagcaacttctattgtttcaccatccgggcttgtccctttcagaggaccatcgaatacatggatctctccagcctcaagtgccttagtcgccttgtcgattgcttcctgagttccctctgctgcaatatcagtattcagtggtgacaaataaactgcgccatctttcagacctttacaccagtcaaccgggatctccttgccgtcgatcacagcctgtactgcatctgttacatagatgccccagtcaatacgtgcggaaatcagggaagccttcggtgctgcttcaatcatatcattgttatatccaacctggaatgcaccgtactcctcagccgtcgttgccggtgctgtagagtctgaatgctgggaaaccacatcgcagcctctctcaatcagagcttttgcaacctgtgattctacagttgggtcgttccatgaatttgtgtacataatatccatggttacatccggattcacgctcttagccccaaggtagaatgcggtatatccgctgataacctctgcaaatgggaacgccgccacataacccagcttgttggactctgtcttcatacctgctgcaattcctgccaggtaacgcgcttcatagatggatgcaaaatagttatgcatgttactcaacccggaatcctttgcctggaatcctgtagcatggcagaactgaatatcaggatactccgctgccacttcttttacatagtcctcaaatccgaagcttgttgcaaaaataatgttgcatccggcatcaaccagttctctcagcgcggtatcacattcagcaccctcaggaacattgaacttgttgataatctgatcatcgcttaatcccaatgcttcctgcatctccttggttcccagatcatggttgtatgtataccccatatcactggcatcagaaacatgtacaaagccgactttcagatcttcttttgcaatgcctgatgtactctctgtcttcttgtcgtctgaatctgaagtgtctgcctctgcagccggtttggcaccgcagcctgaaaccaggccgataaccaacgttgcgcacagcagtgcgctcaagattttctttttcataccttctcctcctaaataaaaactggctaccctaattaagaaacatattccttgattggatagccttatactacttctaaattttacaccggcataagaaataagtcaagttttctgactcgttctttgaaaacttcttaacaaacttttaggcttacggctgtctcttcattttaccttcctgctaccaccgctgcaaaaagaacacaaaagacccgataccttttccaagcgccatgctgatgataaacgcagatatataccgcacgattttcaacctgcgtacaaaaatggggaatacattcaatatctcagccagagccattgaccagcagcccacaaagataccggccagaatcccaaataccgggatcagccagtttccgtgagagatatggatctcaaatactgagaaaagattacctgcaattccgcccagggcgacacagtcttcataaagcagaattctgtcgccggtatgtgtccggtctgcaaaatctgctaccacccccagctctataataaaagaaaacagtccgcccgcgacgacaagcccgccactaagtccgatgactgctaatatgatttgatttacccacatccagctcctgctcccttcttgatgcatcctcgaccagcgttgtctggatgtcattttcgtaaagacgcatctgcacctccataggcgtcggatctactgtaaaacgcttcttcccgaagtgattgaaaaataccaggatacctaccgtaatacctacggaataagaaacctccagaatcgtaaatccgtcggaaacatctcccgtaacaaactcataaatctgagaaaacaattttgacgtggaaacgtcattattaaaagccataattgaaaaagcagcgccacagaaagtaatcagcactacaatgaccgtttttattacatgccataccatcccgggcgtcttctgttcttcataagtgataattatatcctgctctcccatattttgtacttcaagtccaggatatttctcatggatgcaggcaataatttttaagatagagattaccatacgctgttttttcttatccggtatcttcaggattttcaaggttttcagtttgggaatcatctccttattgctgcactccatagcaacaatatcacctaaggtgacatcttttttctgtacctcaacgttcctgtcacccttgagataaactgtatcatgattaacagccatagtattccaccttcggtccctgaatcagagttccctcactggcagagggctgcccgcttccattaaaataataataaaaaatacccacaaccaccgccgcaagcacaatgccaaagaggcagatacggattttccttcttccattttccatagaggccacctaacctttccaaaaatatagtagtgatagtatttgaaaaaaggggcgaaagtatgcgtccgcgtcgtaaaaggtgaggcggcttccggcggacggtgtatgccatttccggggcctcaaagtgcgcgggttagaatccgttagagaaaaaacaggaaatattgagggcagaatttgtttttgtaaaacaaattctgccctcaatatttcctgttttttctctaacggattctaacccgcgcactttgaggccccggaaatggcatacaccgtccgccggaaacggcctcaccttttacgacgctgggtgcatctgggcgggaggcttattttcaggggggggaactatggcgggggcagcggatggtggatgctgcgccccattctctcattctgccccaccaatccactcgccatccgctgcccccgctcagattcccctataggaatctgctctaccggtttgatgaagcccagccggcctggagcgggacttctgcggcgggccgggaaactttcgtgccccttttatcccgcatagagtgcgctttagtgccactagataaaaaccacatcggattggaaggctgaatgctgcttccgaagcagcattcaaggcggcctgagccgtgcaattcatcagaattgcgcggtgaatgccgctggtgccttccaatccgatgtggtttttatctagtggcacttagcaaacggacagcagaataaaaggggcacgaaagtttcccggactgccgcagaagtcccgctccgggccggcgtccccctccctcatctaactccccaaccgccgcagattctcaataatccgcttctccatacgtgagacctgtacttgggagattccaagttttttccccacctgggactgtgtttcatctgcaaagtaccgcagatatataagctgtctttcttctttatccaaagtctccagcagttgtgccaggagcatatggtccaggattttttcctcctttctttctttttcttccagcttgtccacaagacggatctcgtttccttccttctggtggatcggtttatacagtgactctacttctccgccggcttccatggcctgtactatttcttctttgtctacatccattgtaacagccagctcctcgagcgtcggctcgcggcccaggcttgcggtcagtgcttcccttgcctgaaagatcttgtaagacagctcttttaaggaacggcttacctttatcataccgtcatcccgcaggaaacgttttatttctccggatatcattgggactgcataggtagagaattttacttcataggacaggtcgaatttgtcaatggcttttaatagcccgatactgccgatctggaacagatcctccgcatccgtcccccgtccatagaagcgctttactacacaccataccagccccacattttcttcgactaatcgttctctcgcttctttatctccatcgtgtgattttttgattaaagcgattgtgtggtccatagctcccttccttttccgatggttttcttcatccgaaccgtagttccttcacctggctcggattccacttctacatgatccataaaggcttccatgaaagcaaatcccatcccggaacgttccagctctggtttgctggtatacagaggagtcatggcctgttctatattttcaatcccgactccatgatctcttacttccacggtcatctgctgcccttcaatcctgcagcggatggaaactttatgtatctcgttctcatatccatggataatggcgttggttaccgcctcagatatagctgtcttcacatccgagacttcttctactgtcgggttcagctgcgtcagaaatgatgccaccgccactctcgcaaatccctcgttcgatgaatggctgtcaaaaattatctccatttcatttgtgtttttcatgcctcgtcctcctcatatatctgcattatttttgtcattcccgacatcgtcaggatcttttttattctcgcattggcgtgtaccgcccagacttcgcctcccaccaggcggataatcttataccttcccattataactccaattcctgaactgtccataaaatccgtcatctcaaagtcgaaaataacaaacttaatatggttcctctcaatcaatgcatctgcatttttccgcatttcctccgcattgtgatgatccacctcgctgggcaggtaaattgtcaggcagttctcctgcacctgatacttcatagtactcctcctctatgctattcatattcttccggacttttttatgcgctccccgcagtcctgttctctctttcatgtatcctgcgcttcttttctttcccgctgccgttttttcgttactgtgcacgccccaaaggtgtgggcagcaacgtttttcccatcagaaaaaggatatgcagctttctacatatccttatctttcgtgtatcagaaccgcctgagccgcgtatcgccgcgctgcagtcctcttatgtatctcttcttctgcctctattgtccgtctgtattctgtccgtcgttgtctgcactgccggtctgatccgcattaccttcctgctggtccgtactctgctgatcggcatcctgcccgccgtcagactgtgtatctccgccctgtgaaatactgtctaggctgttcttggcctcctgggcacgttccgtatccggatacagctcggtcacgcgcttcagatacttcaccgcgttatcgttatcgccgttgcgcatataggcaactcccagattcagaagtgctcctccactgtcatagccctcgtccattcgcactaccttgctgagggaatcaatcgccgtatcgtagttggccacttcgagggatgctgtccctccggaatacaaagactggcaggcagacgggaaaatgctttgcgccagttcatcatacattgccttaccgccttctcccagtgcatccttattaacattcagcagtgtctccgccatggcatcatctgtataactgttggagtagaattggttggacactgtcatcagattttcataactctccgccgtgctggccgcattctgcgcagcctgctcggaattctcgtcgttttcccggtattggttcagcgtccttgtctgggcgctgatctgtgcttccattgcattgatacgctcgctgtactcgataatctgcttattgacgctgtcggctttcgcctcattcactgccggtacgatcagaaaccacacaatggctgccccgatcaccgcccctacgacaatattcatcaccgtaaacttactggccagcaccttgagtccggcgtgccttggctggatgatcgtctcattccccaggctgtattctaccgtttcctctttgccttttttaccatcttttaccttcttgccgcgcagattagccatctcatgcatatagcgcaaagtcatgtcattcgtcgtatccagctttctggcaatacgaagaatctgcctcgccttggcatactgctcggttcgcaggtataagagcgccaggagctgataggccttcaaaaatgtgggatgagacgcaaccaccttcttcagctggatgattgccagatcctcgccattctggctgcaatacacaagacactgattgtagcgcttcacggcctggttgattatttccagctcactggccgattcctgcacttcactgataaaataatcagccacattatccctgggcttcagattcttactgataatccattcgaccaggccttctgccacttctccgcggccatagtatacaaggcctaaaagatttctggcggcaatattttctctattatattgtaaactccgccgaagtgaggtaaccgcaccggacatgtcacgtatctgcgctttcctcaggccatcattataccaataattggactggtataagattttcttcgtatagtccatctatgctcaccattatctttcttatttcgtctgatccattacttctctcagaaggtccgtcatatctgacaaatcttcctgatatactgcatcttcaatgtcttctacttccaagctaggtttaaacttcttcagttcttcttcaaaatccagcattacacggcctccttttctcaggtattcttgtcaccttgttttctcacagcattctcccctctgtccggaatgagcgcttttatcattcctgtcagataaagagaccccagacagtatatcgtcctgtcctgctgatgtcccatcacataacggagcgcttcttctaaagactcccgcgcaaaaacaggtttctccgtatatttttcaaaaatacgctgcagctcttctatacgtgctgcacgcccgtcatcaatcaaggtgatcatgtagaaatccgtatccagatttctgcacagacaggcaatcatctcttcataatctttatcccgtaccgcagagaacagaataatattccctttttccttatcctgaacgctctgtacaaagctctcaactgcactgacattatgtgcaccgtctacatagacatccggaagtatctcttccatacggccttcccatcttacaccagcaagggcttcccgccaccggctgatcttcccttcatttccaaagatatgcctcatagcctccagggccagaatggcattgcccggctgataaagcccaatgttatcaagagtccatgtagtatctccataatacgcatttacgcaggaaaatgcaatatgtttgtcccggattcccagaatttcgtacgcgtctttccctatttttttacagggcgccccaatttctgcggctctcttctcgattacgcggctgctggcctcttgggcgtctgcatagagcaccggcactccctttttgataatccccgctttctcaaatgcaattttttccagagtgtccccaagaatcgccgtatggtccagtccgatagaagtaattacggatatcagcggcctcccgatcgcattcgtggcgtccagacgtccccccagtccggtttcaagtacaatgtactccacaccggctctgtcaaaggctgtcatcgccatcccgaagagaaattcaaaaaaggtcggatgaggcagattctctgcctccatctcctctactttttccataacgtacccgaagatatccagaaaatcatcgtctgtaatctgactgccgttaatcacaatgcgttcattcatctttaccagatggggggaaacaaacatccctgccgtctttccctgggcaagcagcatggcattcaaatatgcacacaccgaaccttttccgttcgtacctgccacgtggatcaccctgcggccctcctggggatttcccagaaactgaagaaaccggatcgtatgccccgtcttattttttgccgtaaacttcggaatatttaaaatatactctgctgcctctgtgtacgtcacttctcttcacctgtttcctgctctgcaaatgcttcgcggcccggttccacaccgccgatggtcagcggcagctccgtcagctttccgccttcatacttatattccctggatgagcggaatatggtattgctggaacctacctggcacacttgcaggatatccccgtcctcaagcgacgcttcttttaaatcgattctggtattattcaggaatgtactgctctgtttttcaccatttatatagactttactctgtttggtaaaattttctccatagatactataggttccgtccaactgggaaaccagttcggttaccgcagcatcattcactcccatcaccatatggccttctgtaatcggcagtccgctgtctttgtaaacatactgcttcccatataaaatgtcgtactgcagaagttccaggtccgccaggtaattcttagtctgccgcctctgctgatggtaattgaatatcgtgccggaatggatatccagacgctcaaatacatccgccataatctggtatgccgggatatttctatcctctttctcaagcccaatgttatcccagattacataattcgtattatacaggtatctgctcttgagatcctttgcttccagtcccatcgtaggcagatggtctccgtaaaatacaataaccgacggctcgttccgctgttccaccgctttcacaagatcaccggcaaacttatccatttcatacacttcgttcacataatactcccaggaattgcgttttccctcgtcttccactccgctcaccacaatctccgggttctcaatcatcttctccgtcggataatccccatggccctgcacactgatggtaaacacaaagtcctgctgttctgtcgtatccatggaatccatgatattcgggatcaggatatcgtccgtagcccatcccttgggcgtagtctggagaatattcataaactctttgctcgtataatggtcaaaccccatgtggttgaacacctgggcgcggctgtagaagttaccgccgttattgtgcagcgcctctgcaccatatccaaacttacccagcgcggtagctgcgctttccagtactttggtctttgcgtatgttttatagggatattcccccgggccgaagaaacgcatgctcatccccgtcagcacctcaaactctgtattcgccgttcctgcgccaacggaaggaaccttaaagtaaccggtcgaatgctcctgatacatctttctcagattcgggatcggatcttccgaaaattggagccactctacctctgtagggtcaaagtaggattccagctgcacaaatataatattaggaagcgattcttcattcctcccggtggtactctttgtaatactgccgttgttgcttatcttagccatggtctcttcgctgtagcctgcaggctctgagataccggtgttaaatatacttgccgtaaaacagtacgggaaaccatagtcctcataggcaaatgcaatgtttccaaaatagttggagacaacccgcttgtcaatcgccacatccgtcagaaaaacataggctccaagccagaatacaactcctgcaagcgcaagaatgcgatgcattttccccgcgtactgtccgcccctgcgccacatggagatcacccagagaatcactgcggcgatacctacaatcagcaggatcagttcaaatgtattgaaataattgcctgtcagggccagcgcgtcagaaagcaccttcaggtcctgggcattaaaaggcgttacccttttcagaagcagatacccgttgcaggttcccagaaacagccagaatacactgagcagtattcttgcaaaaagtctccgcctgacaagatagacaacggaaaatgtggcaaatatcaggaaagcattgaacaaaaatacttttggcgatcccaccatatagtcccatgcctcaaacagagaatgccgggagatcacctcaatcagcaggttcagcacacatgccagcaggaaatgcagaatcagtgagatcctgtccataaacctgtataccggctgcatcttcttcgcaaacttactgttgcggcgctgttccagaatctgctgccgccgctcccttctctctttccagtgtgctttgacatcttccttttttaagttttttattttatgaaaaaagccttttatatcaggtttcctgatttgaatgtgtttcatttatgacctctcttactatttcttcaagccttccattctctcctgtacctgttttaacatctgcgtgtatttctccaacttttcacgctcttcctgaacctttgcctccggagctttgctgataaacttttcgtttgacagcatccctttggctctcgcgatctcttttgtcagtttctgttcttccttcatcaggcgctccatctcctgttcaaaatcaaccagatcttccaatggaagataaacagatgcgccgggtactacaatggatactgcatcttccccaacaccctgcttttttgcactgatatggatctctgcggcattcatcagtggctttacagaatcggacaaagcggtgaaaccatcgcacagtgctttatccccgcttacgataaagacctttgtttttcggctgttctccacgttcatctccgcacggatattgcggattccccggattacctctttcatatggtccagaacattctcggatgcatcaaaactccactcttccttataaacaggccagtcagacatcatcagagattcctcttccggcacaagtgctttatagatctcctccgtcacgaacggcataaaaggatgcagcatcttaagtgcctgcccgagaacggtctttaacgtccacagtgcacaattggcagcctgcggattctcctccttgtggtaaatgcggaattttgccatctcgatataccagtcacagaattcatcccatacaaaatcataaactttctgtacggcaattccaagctcgaatttatccatattttctgtcacatcttttgccagggtgttgactttggacaagatccatttgtcctcctctgccaattccgcagtcttcggctgtgtcagcgtttcattttcaatgttcatcagaataaagcgggaagcgttccataccttattggcaaagtttctgcttgcctccactctttcattataaaatctcatgtcattcccaggcgcattaccggttaccagtgtcaggcggagtgcgtccgcgccgtactggtcgatgatctccagcgggtcaatcccattgcccagtgatttactcatcttacgcccctgagaatctctcacaagaccgtggatcagcactgtatggaagggggaccggcctgtatgctcgaatccggaaaataccatacgtattacccagaagaatatgatgtcgtatcctgttaccagtacgtctgtcggataaaagtagtccagatcctctgtcttctcgggccaccccagtgtggagaacggccacagcgctgaactgaaccatgtatccagggtatcttcatcctgcgtaaaatggctgcagccgcaatgcggacaggtctgcggaacttcttttgcaacaacgaactctccgcattgatcacagtaataagccggaattctatggccccaccatatctgtctggagatacaccagtccttgatgttctcaagccaatgcaggtagatcttatcaaaacgttccggtacaaacttcagctcgcccgtcttcaaggcattgatcgccggttttgccagttcttccatcttaacgaaccactgctgtttgatcagcggttctaccgttgtactgcatctgtcatgggttcctacattatgggagtgaggctcaatctttacaagatacccctgtgcttccagatcagcaacgatggcctttctcgcctcatagcgctccatccccgcgtattttccgcctttttcattgatcgtggcatcatcattcatgatattaatttcttccagattatgacgcttccctacctcaaagtcattcgggtcatgagccggtgtaatctttaccgcaccggtaccaaattccttgtcaacgtagtagtcggccactattggtatctcccggtttacaagcggaagcactgccgtctttccgacaatatcgctgtaccgctcatcatccggatgtaccgcaatcgcagtatctccaagcatagtctcagggcgtgtcgtcgcgatctccagaaatctgtccgttcctgcaatgggatacttgatatgccagaagaaaccgtcctgctcctcatgctctacttccgcatcagacagagaagtcttgcataccggacaccagttgatgatcctggatcctttatagatatatcccttttcatacagcttgataaagacgtcctcaacagccctggaacaaccttcatccatggtgaaacgctctctgtcccagtcacaggaaatccccagctttttcagctggttttcgatcgttccggcatactcttccttccactgccaggttctctcaagaaagccttcccttcccagctctttcttgtcgattccctcttctttcagctgattcgttaccttgacttccgtagagatcgccgcatggtctgttcccggaatccacaaggcattgtagccctccatccttttatagcggatcaggatatcctgcagcgtattatccagtgcgtgtcccatgtggagttttccggtaatattcggaggcggcatcaccgtagtaaacggctttctgctcctgtcaatttcagcatgaaaatacttgttttcgcaccatttttcgtaagtcttgtcttcaatttctttcggattataagtctttgccaattccttgctcatagtttcctccttgttctccctcataaatatcgtactcttatctctgtaccagccaaaagtcttatgtacagctttctctgatcaggtgtccgccccatcactttagtggctcggatgccatgcagcgtggtgcacggccccgtgagtagcaacccgctttttcacggatttttcacagttttttgaatttaaaacgccctttacttatagtaaagggcgttatatacgcggtaccaccttaattttatgtcctttttgttctgcggacctgcttcttctgcctgcagtctgtcactggcaaaacagtataaggacatctctaaagtcctgtaacgcggacaactccgggataccctactgaatgtgctcttgttcagatatccggttcagaagctaccttccacgatcctcacctgaaaccaccttacagccaacggatgattctctctgccagaagcgatcatgtactcctcttcttcaacacctttgtatattgctaccggacgtctgttacggccgataagatattaataaaatgttaactttatattaactacaaactatcatatctttcggacgttgatttgtcaaggttgtttaaagaatattaagaattctgtattgccatttcttcagaaagtgctataattctcatatggggtattagcgcagttgggagcgcgcaacattcgcattgttgaggccacgggttcgaatcccgtatactccatatcataaggcataacttctataattcttaatattcattaaacacagaaaatataaaacttttcgcttgacttttgagatttttaatgttatgatacaaaaagtattttaaataaagtcttgatttcgcatatattcggtagtcatttttttattgatgattacgtatatatgctttttttagttttatagaaaatgcataaaaaaattaggaggtacctactatgaataacggtacagtaaaatggtttaacgcacaaaaaggatttggatttatcacaaacaacgaaaacggagaggacgtattcgtacatttctcagggctggctatggacggctttaagtctttagaagacggacagaacgttacatttgacattgctcagggcaatcgcggccttcaggctgtcaatgtctgtgttgcataacccaggtttaaccgaacggacgcattacagatcaggcctgcctgaactgttacacggaattataatttccggctaaaatgccaggagagctgagttgctgaccgcacctcgctttcctggcattttttgttgattgatccgattcaggatcattaacatacgcaaaggggatcacgtatgcagggccctgaatggcagcacggtaatataacttcagaacaacgtatcggattccaaaaagtcaattgccggggagattactctcccagctgtttcaatttagaaatcatatccacaatggaatagccatagttatctgccgtggcccagccatacccttccgggttctcctgctgccccagccattccacataaggcgctgatcccttagtcacatattcataacgttcatctacgcactcctgagtcagggcatctgcggtggcataagctttcaggtgctggatctgcgcacgtattccggtccgtacatcgggataagaatttcctgcaacaccgcctccggtagtacccagccctgcaaaattaaactgttcaatggacgcatcccctccatactgcagccacccggtttctttcatggtctgcacaaaaggcacctccggcctgattccttcagcgaccgcctcatcgtaatacatctggcagaatgtctctatgctgtctgcgccgcccttactcaactcctccgccggatacttttcctggctggatttaaaatattctaccatctgctccacggtaaccgtactctttcccataattggatactgcccctcggcaataacctcctccgtctccttgctttcttccttattctgctcgggctgatcctgcgctgttttgttcgtatcctttttttcgtctgcctctgaggcgccgccattcttcccggacttagccgcctcattttccttcactgccttattcagcgtttcttccttcgtactcttttcctgccctgcctttgcctctttcttagtaaatgccccattgtgcccggctaccccaatcacaataacaagcaaaagcgccaatcctgcttcaagccagatttttatcttattcttattcaagcctttccaatccattatcatcacccttgtcccaaaactgtgttgcttatactttacaatatatgcacagtaaaatgcaatatgcaaaaacaattatatgaatatacctgtaaccgttcagacagatctgcacatttatgcgaagaccgcaagaaaacatggtggctgcagacataccgccgcaggcgaatttaaatgttctggatgcggaacagttcaggcatgcctgaactgttacatatatctatcaacacttatcaaggcgggagtcttatctgcttccgtgagaaaacaactggccagaagacgtccatgcaccatagccgtcttctggccagcgtctcatcactcgctgtaccgccttcacaatttaaccttcattggttccatcacccaatattttatctccatgtctcccttttctgcccggaaactgctcataccatcttccgtataaaatcttgtggtaaatacttcttctcccccatttaaatatacctccagacaggttgtatccgccaggatccggacagaccggcactcatccagatacacggccctgctttttcttccataccccagattctgttcctgaagaaaagtaatggtaaacattttgtcacttctgctatagcataaagtaattccatcactaattacaagggtcaggtccgtgtcttcaagcattgtaatttctatatcataatactgcatcttgtctgaggtcttgccaggctccagaatctgctcctctttccgaagtgacagcagttcctctgccggatactgcatcaccttttcatccttcagaaacacctctctgggaacagtaagtgcattctgccaaccgtcgtttactgtcgggttgcactgttcctggtcatccggcataccgatccatccgatcaggagccgcctgccctgttcatccagaaatgtctgcggggcataaaaatcaaaacctctgtcccattcccggaagttcttcaaccgatactctccgtcaaagcttccatccagttcaaaatatccggactgatagacattctgatagtcaattcctctcgtttctaccccctggggagaaacactcagtatctttttctcccccagcataaatgcatcaggacactcccacatgtatccgaatcttttttctcctgtcagtatattcgtatgctcccagctttccagatcagggcttttatacacaagaacctctcccctgtcatccttggtccttgctcccagaaacatataatagttgtcatcctctattccaatgctttttcccgttacaactttcggatcccgtatatggcaggtcagatgatccggatagtcgtcatttgtcatcaggcatttctttccgtcaaagttaaggccgtcctcactgctggagagaaccgtattgctctgccgcccatccgtaatatagttatagtccccctcaagctttacattacctgtgtaaaatagatgcattactccttccgaagcaagggcagaacccgaatagacaccattacgatcgaattcggcctccggtgacagtgcaatccctgcatactgccactccagaaggtccgtgctggtataatgcccccagcacttgctccccccctccggattatccggagaatactgaaaaaacacatgatatactccctgaaactgacacagcccgttaggatcattgagccagcccgtgggcggcatcaggtgcagccccagccgccatttgtcgctccaattcatttctaacatatacatccccctttgtcatttatgattgtctgccggtgattttgatgctcttatacttccctggatttgtaacgataaccggtgttaccgtatcaagtcctgcagctttgatcttatccatatcaaatgccgcaaggagtccgccggcctttaccgtctctccagcctccacatataccgtaaatggttccccgttcagcttaacagtatccataccaatatggataagcagttccactccatccggtgtttccaatccgatcgcatgcttcgtgtcaaacactgccgccacggtacagtcaaacggcgcatatactttaccttctgccggctgtataccgacaccgtccccaagcacgccggacgcaaatgtctcatcaggcacctcagaaagagggataacccggccttttaaagggctgaccaatatcaattccccgttatttccgtcttccgtttcctgctcttctttaataacagcttccacttgaccgcttgttacagacgccgtttcctctttgaagcccagaactcctgtcaatacaaatgcaacaccaaatgcaattgccatcgctatgacatagtgcagcggactgtgcagatgcagaaggattccaaagattcctgtcacgcctgtacctgttgcccccaaatggacaagggacgcatacaaagccccgcacgcaccaccaatagatgccgcgataaatggctttccgaggcgtaggtttacaccaaaaatcgccggttccgtgattcccatacaggcgctcagtgccgaaggcagtgccacagatttcattttcttatttttactctttaatgctactgcaaatgcagccccgccctgtgccacgtttgcggctgatgccaaaggcagccagaatgttagcccgtactgtgccagctggccgatatcaatcaccgtgtacatatgatgtattcccgatactaccgttgtcgcgtatgccccgcccatgataaagcttccgattccaaagggaagggtcagaagactctgaatcccattcagcagcccattttcaacaaatacaaagaccgggccgatcgccgccagtgtcagatagcccgtcacaaagacgctgacaagaggtgttacaaataaatcaaacatcggtggaacgatcttatgaagtctcttttctattatgctgagaacaaaaacagctataataactggaatgacatgcccctgatatcccaccatatctatccgccatagtccaaagaacacctcctgcgttttctgtacaccttctgttgcaaccgtccacgcattctgcagatcgggatggatcatgatcataccgatcaccgcacccagaaatggattggccccaaacacctttgccgcgctaaacgcaattagaataggcaggaaaacatatgcaacattgctaaacagcaccgcaaactgataaattgagccatccgtattaatattcacgtacccgttatttaccataaagttcagggcttccatgattcccatcagaaatccgcttgccacgatagccgggataatcggtacaaaaatatcaccgatcgtcttaatcagccgtttaaatggattctgcctctttgcagcttctcttttcacatcgtctttgctggcctcgctgattcccgcaatcttaataaattcatcatagaccttattaacagttcctgtccccaggataatctgcatctgccctgatgcgaagaataccccctttacagcatccacattctcaacagccgcactgtcacacttatcattatccgcaatcacaagccgaagcctggttgcacagtgtgcagcagagatcaggttttctttttccccggtatacttcagtatctgttccgctatcgcatgataatccataacgccctccttcatgatatcgttatcactttttttgtttgatatcacgttaatcctcatattttatgtgatttttaatatgatatcgttttcatatttaatatatattttatcaccttttcaagatctgtaaataggtagatagaacaaaaatgcatgccattttttgtctatatttcacaattctagtataagacaatttaaatgccttgctggttcggtgagaatgattttccgaaagtgcagacgaaaaacgcaggcgtagcggggatacactgaggcttttgcgtctgtgctatcggaaaatcaggccggcgaaacagtaaggtatttagattttcttatactagtacgccttggcgtacttgcggcgaggtgcgtcatgttcctcctgacattatacctctgcgagcctctgtcatccgctgccagctttatcccggaaaaagatttgtgttactgtgcacggcacggtctgaacagtaacagatttgtctcccattaagacgaacttgttacttatttacacttatagggtaggtgtcttatctgctttcaagataaacattattccctgaaaataccacaattatgtaaaaacacataatgagcgcccgttcttaaaaaattgcgcattgacacaaaaatgaccggagtttatggatgacttttgattcacaatatcaaatgtcatgaaaggatgtgctgcgttgccgtcggacaacacagcgaatccttcttttaccatacaatccggtcatttattatttaactgcacttaggaatggacaaccagcacagccataaacactttccactccagctccttactccagaattcttctctcactcttatacactctctgccttaaccacctcatacccgagctttgtctgcctgtatatgttcgcttcattctcgatcagctcaagcagcatatttgcggcctctattccgctggttctatagaacagatgagctgttgttattctgggtgtcaccaccctggacaagcgattatgcccgatccccgccacagctgtttcctcaggtatctttctgcccatatccttgagacatgttacagctcctactgccagtgtatctgtggcacaaaatacagcatccagttccgggcatctgttcaccagtcttttcatactttcataacccgcctccatgttgaagcctgccgttattatcatcttttccggtacttccagtccatactctttcattgcgtctttataaccttcggtccggctcttccccgcggcctcatccttctgtgacacagctatatgtgcaaccttctttttcccgctctccaaaagcagctctgtcatcgctctggcagcgccgtaatcgtcatgatagacacaggcgcaatcgtcaaacctctgactgataataacaattgggatccccagtttcttcaatgcttcctgatgcgcccggtcataaacagaagccgaaaacaagattccgtcgaccgggttattcttcaacagattgagatattcaatttcctttttgggattattctctgtactggccagcagcatctgataacctttttccgaaagaacagaactgataccgtcagccacccttgctatagattccgaactgatcttaggcagtatcaccccaatcacctttgacctctttgtcctgagaatctgcgcctgcttggacggtctgtagccggttttatcaatgacagccttaatcttccgcctcttctcctcgctgatatatccatcattcaaatatctcgaaacagcagataccgagacccctgccatcttcgcgatttctgtaatcgtcattgtcgttcctctcaatccatgcccccctgaaacggagcaatttatactcataaaattatgcagtcctcgcttcctcaaaaggaagcagctatacccatagaataattgtagcatcctacttagggcaattcaagctggattttagcaattatgtatttaagcaattcagtgtattggcaatttcatttcctatccccgcccccaatcccatccgcctctctccaaagtcttcccagagtattgcgtctcccgccctatagcgccagccgcaggaaccggacatagaggccgccggaagggtcagcacggctgttagccggagttaaggaaaaaagaaggaaagcaggggtaaaaattgtaataaccaaattacaatttttcctgcccccagcgcgtgaagtcatcaagacctcacgtgatgtgggcaggctgcccctgctttccttcttttttgctttactccggcttacagccgtaacccgtttccggcggcctctatgtccggttcctgcggcgtccccataccaggtccaacagctttactccacaacgacccctttttgaagcataatattcgcataaagcgccttctcacttgtagcgatgattgcataagctgtctttgcctcatcataaaatgcgaaacgctcaatattccccactgcgtccccgcctctttcatcatgttttgcaatgatttctttatatgtatcccagatcggtgtctctacatcgtcaccatccataacctgcatcaggtttaccggcttttctacatatgtatccagagggaatacctgaaggatagcatccaggatctccggaaccccgtgtccgtcacagcggatcacgattgcgtcctttcccatggattctgccggaaagttaccgtcagagataaccagtctgtcgctgtgtcccatttcacataatacttttaataattctggtgataaaatctgtggaattccttttaacattgttcatgtcctcctgagtcttagtcgggccggtgcctcctggtattacatttcgtatgattcggtgcagacagcaggtactgtcagcactgaaacttatatcatgaaatacgcaggcatatgcgcccataaatgccaatacaaagagcacctggttggcacaggcactctttgtttggttagttaggtattggttttcggtgtttcacaatagtacagacaattctgaactatcgcggtatttccgcaaaatatatttggttataatcacttggcggcaattatcgaatggacttgtacattggtccataagcctggcatgctctgaaatcctggccctctttgtcctgtccgaatgcattccatgatgcaggtctgaagatcttctcttcaggaacgttgtgcattgctaccggaattctcaggattgagcagagtgtgatcaggtcagcaccaatgtgtccatagctgattgcgccgtggttagctccccagttgttcattacatcgtatgcggatgtgaatgcgccttctcctgttactcttggtgcaaaccatgtacatggccatgtatagtctgttctcttccacagcacgtctgttacttcatccggaagttttactgtccatccctcagcgatctgaagcattggccctaaattcttcacaaggttcagacggatcatggttacaggcatctctgcttctgttacgaatctggatgagaatccgccgcctctgaagtatccgaagtcagcatagttccaggtcgttgcattgagcattgcttcctggtcttcctctgttacatcataccatggcttcatacatccgtttccatcagcgtctttagactgtccgttcgcatccaggcatgctgcacctgagttaatcagatggataaatccgcctgcttcttttgcatgtccttccagttcatatccgtccgtagctctcttaacagcctcagggctccaataggtacgtacatctgcaaaaatctgtgctgagtttgtaagcaatttgctgaacagcattccaagtccgttcagtacgtcgttttctgttgcaaggatgtatggttctcttgctccgttccagtcgaaggaggaattcagcatagcttccgggaagtcacagttcggatagaagtctgtccactgtctctgtccctggaatccagctgccagagcgttgtgtccaaccatctcttcttctcttccttccggcagattttcgttgccgttcatcaggtctttgatgatgcacatcatttttacaacgaattcccaatcagcttccttttcctcgctgtttctctggaggtcttcacggttcttatcaaaaccttctttgcatttctcctttgtccatgcaagagctttctggaattcagcttcatcatagataccctctgtcatgcggcggatgatttccacctcatccacagattcaacacgcatgccaaggtattcctcgataaatgccggatcaatgattgatccgccgattcccatacagatagaaccgatctgaagataagatttgcctctcatggttgctgcagcaacggaagcgcgtccgaatctcagtaatttttcttttacatcgcatggaatctcagtatcatcagcttcctgaacatcatgtccatagattccgaatgccggaagacctttctgcgcatgtgtagccagtacagatgcaagataaacagctcctggtctctctgttccgttaaatccccatacagccttgattgtctgtggatccatatccattgtctctgcaccgtagcaccagcaaggtgttaccgtcagtgtaatgtcaacgccttcttttttgaatttatctgcacatgcagcagcctctgccacacgtccgattgtggtgtcagcgattacaaccttaaccggctcgccgtttgaatacttcagattctctgtgaacagtttagctgctgatttcgccatattcattgtctgttcttccagagattcacgtaccttcagaacccctcttcttccatcgatcgtaggtctgataccaattactgggtagtctccgataagtcttgattttgccatgatttgtttcctccttattcttgtttcaatccatgctcggtaatttcacagagtacgactacatcttgtacagatgcacagcttgacctcatgtcagtgtgggataccgagtcctctctgcccgacactgccattaatcttgcttttattgatttatcgctccacctatacaggcgggaaaatccttcttaatcttgttgaattaaagttttaaatttctcatatgccgcattccacttttcttcatcctgcggaatgtactcatatgtttcttctgaatctgcaataatctgtcttgcctcattcacgtctttgatctcgccaagggacataaactgtacggcaatgttaccaagcgccgtagcctctaccggtcccgcaatcaccttgcggccgttcgccccggcagtcatctggcagagcagtttgctctggatcccaccgccgatcatatggatggtcggatagtgctttcctgtacatgattcaatctgctccagagcatatctgtatttcagcgcaaggctctggttaatgcagcacatgatctcaccgattgtctccggcaccttctgtcccgtcttacggcagaactcacggatacgttccgggatgttgccggccggaacaaattccggcgcatcgggatcaatgaagctctggaacggctctgcttccctggccatctgttccagctccccgaaggagtattcctggccttcgcggatccactgtcttctgctctcctgagcaagccacagtccgataatattcttcagcagtgtggtggtatcgccgtaaccaccctcattacttacattgcatgcacgggatttttctccgataaccggagctttcagttcggttccaaacaggctccaggttccacagctgataaacatgaagtcctcttcctgtgtcggtacagctaccacggcgctctgtgtatcatggctggcaaccgcgattacctttgccggctggattccaagctcttcgcagatgtcaccgctcagagtccctacgaccgtcccgcttggcacaatctccgggaaaatatccttcggaatacggagtgcatccataatcttatccgaccacgccttgttccttgcatccatgagctgtgtagttgtagccatcgtatactccgcttttgtctccccggtcaggaagtagttaaaaagatccggagtcagtaacagcttgtctgccctttccagaatccagggcctcttttccactaaggaatagagctggaatacagtattaaagttttcaaactgattacctgtcatatcataaagttcgtcttttggaattgccttaaacacttcctcctgcatgccaagtgtcctgtcatctctgtaatgcacagcactctcaagcagtaccccatgctcgtccagaaggccaaaatcaaccccccacgtatcaattccgatactgtcaaagccgcctttttgttttgctttgataataccctgttttatctcgaaaaattgtctcaatgtgtcccagtacattgtcttgcctatgataacgggatcattggaaaaacggtatacttcttccatatgtatcttcccgtcctccagggtcccaaggattgcacgtccgctggacgccccgaagtcaaacgcaagaacctgcttcttttcactgctcacacacattcctcctttcaaagatcattaaccgtaacagtttcgacaagtctgaactgtcaccatgaacctgtcattagctacattttaacattgtccatgacaagatacttgtgctataatggtaaaaaatataacaatattcacataaaggagtatcatgcagtatatcaattaccgtgaaagctggcagaggggtactgtcgactttcccgtagaataccaccatattacccccgcgcatccccaatatatcatgtcgctccactggcatgtggaatttgaaattatgcgtataataaaaggcactttcctgttgtccatcgatgaagaggaattcacagtccacgcgggttcttccatcatcgtcccggcaggcgccctgcacgctggaactccccagaattgcacctatgagtgtattgtttttgacatgaacatgctgatgaataaaaacgattcctgccgcaaactcatcagaaagatcattgatcatgaggtggagcttacttatgtatatccggattcctgtaacgatatccaccagatcgtctggtccatgttcgacgcaatggcttccaaaaaagaaggttatcagctgatcgttctgggagccctttatcagctgacaggctctgttttctctgaaaaatattataaccctacgcccgcgcagcctcccagaaaccatcggcgtatcgttcagctcaagacggcactggagtttatggaatcggcctacaataccccgctcactctggaggagatgtccagcagtgtcaatatgtcgcccaaatatttctgccgctttttccaggagatgacacaccgcacgccagtcgattatctcaactactaccgtatagaacgcgcctgctatcagctgcttaccaccgatcagtccatcaccgaggttgcttataattcgggcttcaatgatctgagctactttatcaaaacttttaaaaaatataagggaactacaccgaaaaagtatctctgctaatggggtcgaatggggggacacggatgtgggctggctatgaattgcggtttagtcggctagctttagcctagtcgacggacggggacgcttcatgacagggaggccggggaggtgctggggctgtatatgccgttgcacctccccggcctccctgtcataaagctggctcatccaatcggcaggaaagctcgccaaccgggtgggatcccggaccagggcagcggatgtggattggctatgcgtatcttttcatcttcaaaatgtgtattgaattattttgatactggaaccgtatcccatcgcttatgtacacctactggggacatagaagtcccgccaattcaataccatacgctgctcccgcttgaggcatctccttagaaacgagctttttcctgccggttggatgcgccagctccatgaagggatagctgaaagcctcccggagaacatccatgtcctttcaaaaacgctcaaagcggaccttagaaattcttggtgggaaacagcccggaaaatggagagatttttggattccgaatccaaaaatcagctgacccagcgcgagaaatcatcggatttctcgtgatgtgtcagtggtgctccattttcagggctgtttcccgcctagaatttcttagatccgcggccgcgtttttgaaaggacatggatgttctccgggaggttttcggctatccctttatggagcgcccccatccgcgccgggactaaagcccgttgctaaatcccgatttaattcaaagatcttctcaggcattaccccctcagctgcaaaccacggccctaccgtcagatcccactttttacacacttccgtagccctcagcctctcatttgccgcctcataatctccgtcctcacattcaaagtagataatcgactgatcctcaaaataccagatcagttcattgataaatcctgcagccctgattgcctccagcatttcaggccatggattttggtggattgcaatatattcatttcgcatctcaggtttcacctttataaccatcagcagccgttccatactttgttcctccttattcatatctgccatattgttttgctttttctataaaaaacttcacccgctcaggcgtgacatcgacctgtataatatgggccggcgagatgacataacctccgtttcgtcccaacacttcacacttttctttgatatctgcctcaacctcttcatctgtaccgtttggcaatagatactgctggtcaattgccccccagaagcagagtagatcttcaaattcatctttcagctctttcggggaatgtcccggtactccgggctgtaccggattaaatacatcgaatccaatttccttgatatcatgcagaagcagttttacagcaccgtcacagtgaagtatgcagaggatatcttctctctcttttttcaattcttttatcatctgcacataatatggtttcagcatctttctgaacatatccggggaaaacagaagactggtctgggaaccaaagtcatctcccacccagatagcatcgactccacggcgtatcagttcttttcctatttcggtctggaactctgcacattttccaaacaggtattccacatattcctcttccatggccatatccacaagaagcttctccatgccgactaactgctgtgccagggacaggattgtgacctcaatatccccgatcaccaaatactcgtctttatatctcttcacatagtattccgcatcaatatatctgcttgggtcgtgtggatcaggccactcaaatgcgtcgatgtcctctcttgtctcggcttccgcaaggggaaattctaccgtttctacgtaaagagggccctgcttcaacttttggtggtattcattgtaccaggttccgtctgcttcaattacttttgtgaactctgcggcctcactcgctccgacaatcaccaggtcgcttcccatggccagccgcacttcattgccgctgatccgataggtcacgtcttcaaatatgttgtccgtatacctggactccacccccagctcctgtgcaaaatgatcctgaaggctcctgcataaatcaaattgtatcggaatcctgtccggcattccttccttcagcttccatgcgcgcattactctttctcttgaattcatattttttcctcaccttcttctattagtctttcttccgttccttcatcatgtcaaaaatcactgccataatcagtacaacacctctgattacctcctggtagaaggatggcacggagagcaggttcaggccatttgataatatggccagtattaatactcccatcacggttccgatcagtttgccttttcctcccgacaggctggtcccccccagtatgacggctgatatggtctccatgttgatctctgccgcggcgctgggaattcctgcgcccgactgtgcagacagcattattcctgatatacctgcacaaaatcccatgataatatagatccacaggtaggtaggaactactttaattccggacagatatgccgatttttcatttccacctatggaatagacctgacggccgaactttgtatatttcagaataaaccaaaacagcataaataccacaatcataatcaatacgggcagcggcagaattcccaatatatactttctgccaattgcattgtacgcagtattctggatcaggattgtctttcctcccgaaaatatctgtgccagaccgcgtatgattgtcatcgtgcccaatgtcgttataaacgcattcacatgtccttttgtgataatcatcccgttcgccagcccgcagacacctcccgcaagaatcccggctgccactgcaaggaacgtattgcctcccgactgcataatgaggcccgctatgattccgaccagcgccatcaccgaccctacggatacgtcgatcccgcctgagagcagaaccagcgtcatccctcctgccataactcccatctgggccgtataaagacctaccttcatgaagttggacagagaaaagaaatagggggacaatatactgaacacaataagcataattaccaggacaattaagagggctacctctgtcgtcaatttctttttaactttcgtctgtttcaacaccctatttccctcctactactaattccattaatttttcctgtgttacttcctgcctggacagctccccgcagattcttccttccgacatagccgccacccggtctgacatggacagtaattccgacatgtccgaagagatcataatgattgcggttcctgccctgcacagctcgtcaatgattttataaatctcggatttggctcccacatctacgccccgtgtggggtcattcagaatcagaagccgggggttaatttccatccaccgccccatgaccaccttctgctggttgcctccgcttaagttttctatgacggtctcccctgtaggcgtcttgatcccaaacttttcaatccatttctttgtaatccggctttcttctgaccggctgatgattccatttttcgtaatcttgtccagtgatgccattgtcgtattctcacgaaccgtctgtatcagaatcagagagccgctctttctttctgccggcacataggcgattccatgcgcaattgcttctctgggatgatccactttaatttggtttcctttcataaacaggctccctgatgtaatatggtgcaggccgaaaaatttttccgccatctcttctcttcccgcgcccatcagtccatagattccaaggatttctcctgatttcacctgcagggtaatatctgtgactgcttttgttgtaattcccttcgcctcaaagacaatttctcccggtttggccgcttcctttacaaacatatccttcatttcccggcccaccatcatccggatcagctgctctcttgaaacacttttcatatcctctgtgcctatgtactggccgtctctcataatggtgatcctgtccgccaccagatacagttcttccagtctgtgggatataaagattacgccgatcccttttgccgcaatctccctgaccagcttcacaagactggttacttccttttcattcagagaagaagtaggttcgtccatgatcagaattttcatttccgtactgagtgcctttgccacttcgatcaactgcttttccataaccgacagctccccgatggggcgggtcacatcgatatgcagccccactttttccagtagtttcccggcctctgcatttgttttcttccaatccactaaatggaacttattataataaagatttccctggaaaatgttctctgccacggaaaggtccggaatatagtttaattcctgataaataatccggattcccaggttgtacgcatccgaagggttgtctatggtgcacttccgcccctcaatgtagatctctccttcgtctttttggtaggcgccggacaatatcttcaggagggtggacttccctgctccgttttcaccgagcagggccagtacctcacctttttttacttccagatccacgttatccaatgctttcacgccggggaatacctttgtaatgcctttcatctctaataaggtctgctccttatccatattcccacctccccgggcttaataatactcgtcaatgttggatttatcgataaatacatggtccggaaaactctcttctggaatctctttgccatgaagcagatcatccatcagaggtacaagatattcgccgtaacgttccgggaaatatgcaacacttccaatccagcagttctcttctttgtttttcaggttttcaatcgccggagcgtcacacccatggcttcctatgtatacatcagattcccgtcccgccgcttcgactgcattatatgcgccaagtgcactctggtcattcaggcatccaatcaggatatgtttcttatccggattggctgtcagcacatccgctataaccttctgggatgtctcaatctcgctctttccatccagttcaagaacttcaatatcttcgttttttaatgtttccttgattcccgtggcaattccctgcatcctaagatctaccacttccccggaacccggagcgccgcatagtacaatcagatcggtcttgccttcccatgtatccaccgctttttcgcccagtgcatttccgacgatcagccctgcttccttattgttcgctccgaaaaacgggataccgggatgcgggcagtccacggtaatcattggaagttctgcctctgtcgccatatcggcgattgtctgtgcaacccctgcgtcaacctggaaattgacaaaaccatcgcactcctgggtcagtaccgtatccatattctgaattgccgtagctccgtcataattgttattcagaattacaagctcccaccccattgcctccgcttcttttacaaagctctcttttgatgagattccaaagtcattgtcctcgcacagactggcaaatgccaccttaaacttttctttttccccatcggtctcttttcccttatcttctgttcccggatcttttgccccacaagcagccaacccggccaccatcacgatactgcaaatgactgaaatccacttttttctgtttttcataaaatttcctcctgtaatttttttgaaaaccgtttacaatcgattgtgtgttttcgttttcatggcaagatattatcacacttcttcatgtaaatcattgctatattttgactttaaggactcattttttgacctattgcatagttcgattagctttttttctgctttttatggcattctgcacataaacgtgctagactcaaaaaaagagaacaggaggatgtaccatgaatgtaaaagaagcaaacagagaatataacctggacatcagtgaggattcctacagcaccattttttatttttctgaaaaaacggacagcatgccttttttctcttactgctccggacattttttctgtaatcagaactattacactgtaaaccgtgtgttagaaggttatctgattatctatacaatcagggggtgcggtcttttagatatttataataaaacttataccctggatgccaattctgtggtgctgatcgactgtgatatcccacattcctaccggacaaaggatgatacatgggagctttattatctaaggtttgctggaaaagcggcggaaacctactatacgatgatatccgcacctgaattccgcgtactgcattttaaaagtacggataatatccgcacctgtatagagcataacatcaatatttcttttatcgccggcatacgctccagttttatccaaaacaagattataaccgatcttttaactgacatcttgttaaattgtaatgcatcggaaaagaggattgatgattccacgaaagaaacccttaaggctgtggatcaatttatttttaagaattatcagagtgcgatatcactagatgatatcgcagaacatgttcatctgaatgtaaattacctttccaggctttacaagacgaataccgggacgaccattcatgagacgctccttacatatcggattaataaggcaaaggacctgctgatcaatacagatttgaaaattgcagatattgcggaacaggtcggctttcagtctgccagtacctttatacgctgctttaaaaaacaggtacagatgaatccgctggcttacaggcagtgtatgtaaacgccatccagttaaaacttcctgcaaagagaaaaggaacgctgcatccacgcgcgttccaaactctgtctttcttccatatattacgatccgcagtaaccttctctgccgcataccaggcttctcaatgccataagccaatagatatttagaaaataccaaaaatcttttcccggaatgactgatataatgagtcataatccgtatacttaattttactctctttaaaactctttccccatacctggcagatcccctctgcaatcaggtttgagtcatccccttccagccccagaactgacggaaaaacatagtagatcataaagaaattcaaatctacctgcgtacgggagtcaatctttcccttcttattagaaaagtgatcattcactgccttcaccaggcattccccaatttccctggcggcagcttctttgtcctcagcccgagcgacatactctgccatttcctgaaaataatggccgttcctttcaagaaattcagccgtattcttttcataggacttctttttcagatgtcccagcatcttttccttattatcaaagacagtttctataccctgaagcatatatttcctcctgcgctttttctttctgatctcaatctacttacctttccttatgcgggatgcgttttagaaaaaaggaaccgggacactcccggttcctcctgaatcactatagtttattcaactatatctttatgaattagtcatacaggtttggagcgatgtctgcttcttccatgtttgtggaatcataccagtaaccatctgtctcgatatcttcaactgtttcgccttcgcagatcttgtacagtgtttcgattgataatttaccctgcatcagaggagactgtgtaacagcgccaagtaatgttccgtctttaacagccgctttgatcgtagaaccagcatcgaatccagctgcgataatgtttttctcaggatcgcttcctaatacgctcaggttctggtttgctgtcagaacaccctctgcagatacctggtttgaaccgaacatagcgattgtgtcgtctttgttcatgatgttagaagcctctgtagcacacagttcaactgttgtctgagccggtactgcaacttcaatgataacatctgctgatttctcatcgccattgttttctactttacctacaaagtagtcatttcctacaactgcaactttctttccgtctttttcagccagttctttgaatctgttgatgaatccaagaccacgctctgtgatgttggcagatgttgcatcctgattaacttctccgactctgactggttttttagcatttgcaattttgtcttttactgcttcataaatcttatcagctgcaatagctcctgctgcgccgttgtttgttacaactgtagcgtatacagatccttccggagcatccggcacacctgaatcgaagcaaactaccgggatctttttatcaagtgctgtctgcagagcgtccagaactgaattctggtcacaagctgcaagagcgataccatctgggtttttattgattgcactggtcagcatgtttacctggtcagcgatatcagactccgcgtttggtcctgttgtattcgtcttaacacccagttcttcttctgcctgtttgattccctgtacggctgcctgccagtatgatgactggaagctcttaacgataacttcgaagctgtaatctccgccgcctttgtcggaaccttcgcttgtatcctcagtctttgtgtcggtgccagctgctttgtcgcttgcttcctctttctttccgccgcagcctgcaagcagtcctgctaccatgcatccactaagtaatactgctaaaactttctttttcatatttttgtcctcctgacataaaatggttttttatagtaacagcccctctgccgtctccagtccccaaccggaaccggcactggctgctatctatcactaataggtttactactgaaaatttgattactgaaactttttatttctgttacttccgctccttcggttatgcctggtcttttttcctcttgagcatatctacaagtacagccgcaatcagaacaagacctgtaataatctgctgccagtttgctgtcagcccgatgaacggaagacctgtcttcaagagacagataacaaatacaccagccagcgttcctgtgatgcttcctgcaccgccagacatggatactccgccgatgatcgctccgccgatagcctccagctcaaatccggcgcctgttcccggctgaaccgttgcaaaaatagcggaataggaaatcgctgcaagtcctgcgaagaatccggaaatcacataggtaagtatatgatagaatttaacattaacccctgataatctggttgcttctttgttgcttccgattgccagtgtatagcgtccgatctttgtatgattcaggacaaaagtcatgatgattacgatgatgataatccacaggaaaccaatcggaatgttcatatcgttcacctgtatcttgaagatgcttctgaaccatcctccctcagcagctgctgccggccaggagattccgactcttccaacgataatggaaccaagtccccttgtaatcatacaggtacagagcgtcgccagaaacggcggtaaatccattaatgctacgaggcatccgttcagaacgccgattgccataccgaatacgatacttgcaaggattcctgcccaagtcggccagccctggaatgtaatcaggtatccgccaaccagtgagtaacagataagcccggtaccaatggaaaggtcaacacctgccgtcatcagcgggaacgcaacccctattgccatcaaagtgatataatatgaataatccagtatactaagaaaagtggtatactttctaaaattcgggctgagtgcgcagaagaagatgaataaagcaattacaaccagaagaacgatgaatttctgccctcccaatctgtcaattaccgacctgtttctgccagccgtttttgttgtattattagccattttattatcctccctactctatctctcgtgtagccagattcatgatgttttcctgagttgcctcggaaatatccagctcacctgtcttcctgccttcacacattacgacgattctgtcactcattcgtaatatttccgtcatctcagaagaaatcattataatggcttttccatctgctgccagcttattcatcagcttataaatctcattcttggcaccaacgtcgatccctctggtaggctcatcaaatatcaggatatcacagtttcttgtcagccattttgcaataacgactttctgctgattaccacctgacaggttcactacaagctgatctacatccggtgtcttggttgccagtgactctacgtacttttccgcaacctctttctctttcttcttatctataaagataccgctcatgtagttttccagtgtcgccattgtcgtattctcggcaacagtcttctgtactacgattccgtatctctttctgtcctctgacagataaccgataccatttttaaccgcatcctgcggagtgttgattgttactttcttgccgttaatatagatgttgccgctgtcgatcgggtccgcaccgaacagcgcacgcgccgtctctgtacgtccggctcccataagccctgagaatccaaggatttctcccttatggagttcgaagctcacatcctgtaccatctttccggcattcagattttctaccttcagcactaccggtgcatccttcggcaccatgctctgggtctttggatcttcgtaaataacacggccgaccatcatgttgatgatatcgtcttttgtactgtcctttgtgatcagagttcctacataggcaccatctctcatgacggtaactctgtccgtgatcactttgatctcatccatacgatgagagatatacacaatacccatgttcttttctctcaggtcacggataatcttgaacagttcctgaatctcagtctctgtcagcgctgcggatggctcatcgaatacgatcaccttcgcatcatgggaaattgcctttgcaatctcacacatctgctgctttcctacggtcagcctgctcatggtctctcttggatcaatatctatattcagtctttggaaaagctttctggcctcatcattcatcctcttgtcatcgatgcggatgccctttttgaactccctcccgatgaagatgttctgtgcaaccgtcagatggcccagcatattcaattcctgatgcacaataacaatccctgcatcctgtgcctcttttgtacttgaaaattctacttcttttccttcatatgtaattgtaccggaatcttttttgtagatacctgtcaacaccttcatcagtgtagacttaccggcaccgttctctcccatcagcgcaaggacttcaccttttctgacttccaggtctacgtgatccagcgcatgaacacctgggaaagatttatcaatatctttcatcgttaatataacttcgcccattcttttacccttgcctttctatttcttcattctcagatttccatgtatcattattagttctttctgcgtcttgcgacaacatcactgaatactgcgacaataacaataatacctgtaataataagctgataatcttttgaaaagccaagagccagaataccttcctgcagcagagcgatgatgaacacaccgattactgttccgctgatagaagcaagcccgcctgccatggaagttcctcccattacgcatcctgcaattgcttcgttgttgtactgatcgccatatcccggctgaactgttgtgtaagcagatacatagaagagtgctccgattccaaccaaaattccacagattacgtatgctgtcatttcccatttcttaacgttaacgccggaaagccttactgcttctttattgcttcccagtgataagatataacgtcccattttagtcttattcagaataatcgcacagataattgccactataaggaagataatcaggcctgtcgggatgtcccccatcttaaccagatatctgtaccatccgccctctgcggaagactgcggccagcttacagactgtgtctttgtaaatacagatgcgaggccttttgcgatattcatactcgccatggatgtaatgaatgacggtacggaccagtatgctaccaagtaaccgttgaagataccgaagagaaggccgaccagaatactgatcaccataactaacggcatcgggactccatatgtaatgaggctgaatccggaaacgagcgcacagcagaacataaccggcccgatggagaaatcaattccccctgttgcaattacaaaagtaacccccaatgataaaaatccaagaaaatatgcatagttaagggcactcagaatacggctgattcctgcaaaatctccctgcgtcatcgcgcagaagaatccgtacagaagaatcaaaacaaagcataacacaaccctgttaaaccccaccttttttacaaaaggattttgtttaatcttttccacttttcttcctcctacttctttaatcttgctgctttcagagatgctgcatcaattctctcatcctgtttcaaatgctgtctcgtacgtatctgcatattcccgcttctccccgtcttatatatcatttcgtgaaagctacacttgcaattccggaaaaacatgattataatacgtttatcttgccgctcaggatgagcaacaaaaaggaggttcacatgaaacacttacgtacatttttttctgtatcactgattatcgttcttgccataaccgctcttacaggatgtaagaaacagccgcaggctgtcaaatctccatttacggagatgacctgggagaactctgttgaagatgtgatcgccgaggaaggcgatgactatacaacctatgaatccatatataacggaaccacttatgagttcgccaagaactatcttgatcaggacggaaccgtaaaatacatgttcgacgacaacgacaaactaatgtgtgttgcctgggccttcggtacagacgatgaagaaacactgaaggacacctataataaaatccatcaggatgtggaagatacctacggcgaaagcggttatgactcggagaatcccaccaactacggcgatgtctggtatcttgaaaacggtaatatccttttaatggttgttactaccgacacccagcaggctcttcagtattcttatctcaatccggaagtatccaccaaagaaacagaaaactgagtcaacaaacatttacaatcaagatttattcatagtatagtatttatgaactttttattaaattgaaaattttactgaaaaaggttaaaaaattacagtctgtaaaataccgaccgtaaatttttaaccttttcttctttatttttatatcattatttttcggcttcactgaagacctgacctcagggcatgtgccgcaaaacgtccccgggtatccattattgatccactgcaagatactttatacaggccgcagatttcactgctggccggtaaatggatagagcaggcgctggttttcttcctcatacatattttctttagtaatcatcttacagcccgaatccacatttttctcgtactttttaccatccaggatatggaccgcctgttcaacgcccaaataccccatattaaacggcttttgtataataatcccctggaatacgccttcctccagcagctgaatctcctcaatagagttatcgaagccgactactttaacttttcctttaagtcccaaatcttttaccgctctcgctgcccctactgccgagtattcattcgtgcccattataacctccatcttcggatacttttccagcatatccacagtcagcttatacgctctgtcataggaagaaccgcaaaacacgacgtccataatctgattttcatattcacccaggccttctctcatgccgttttcccgctctatagcggtcgatgagccctttacatgggccactatcccaatctgtgattggtctgtcaccattccccgggtaaactctcccagttcccggcctgccagataattatccgtggcaacaattccctgtgcaatatccctgtctatcacagaatcaatcagcaccagtttaatcccatgatccacaaccttctgaagagcctccgacatctcggaatagctgcagggagagacaagtattgcgtccggttgtttttcaatcccctcttggatacacttgatctgcccctctacatcggtctctgactttccccctacgatttctatgtccgccttaaactcttcggcccccagctccgctccggcgatcagagatgtccagaagccattcttctcatcgatggttttgggaattaagatcatcttatatactttctgatcctggctctgcatactcagcaggttgaaaataatcagaaaaagtgcagtgaggatacaacataaaaacattcctgttacaagcgttttacctgtgagtttcttcatcatcttcctgctcttccagcggcaccgttacggttgccactgttccaacccccttcctgctgatataagaaatcccgtattcctgtccatagtagagcttcagcctcttctgaacattggggactcccacaccgtttgatttatgttctttttttgtttcatcaaaaatatgctccagggcagcttcctccatccctactccgtcatccgcaatcgtgatataggccttctttccccgcacatatccccgtatgctcagatttccctttgtgtctttatacttcagcccatggtagatcgcgttctctacaatcggctgcagggcaaacttaataatcatgacatgattgatctcgggagaaacatcaatggaatattccagcttatctttgtagcgcatcttctgaatggtcagatagctgcgcacatactcaatctcctcggcaaccgtaacctgctccttgtcattactgatactctgtctgaaaagacgggccagcgctgaagtcatcagtaccacctcgtcatttcttcccgcttcagacatccagatgatagaatccagcgtattataaagaaagtgcgggttgatctgcgcctgcagcgccttcagttcgtttttccgtttctgtttctgctcgtacacattctgttccatcagcgtatggatgcgttctgtcatcacattaaaggatttgctcaggcttcccacctcatttgatgcggtgaccggtacatttgccttatcgaaccgcccttcttccaccatgctcatggaatctctgagctggcggatcggcttagtaatctctctggatataatgctggatatcgcaataacccccagcagaagcactcccgccaccagaaggtacatcatctgcgcctgcttgttattttttaacagctccgaagtgtaggctgcccctacaacggtccatcctgtcatatcagatttggatattgtataaagcttatcgccctcttccgactgaaaatggtcttttgtactggacatgatctcatcgatattttccgtcttcagaccgccgtacatcaactgctgctggggatggtaaataatatttccattctcatccaggataaagatgtagccgctgcctccgatattattgttactgcacagtgagctgatggcattataattaaggtctataaaaaacaccccgccgttttcacctgtcttgtagtttacgagcggtctgctcagagtaatcacccatttataactgctctgaatggcattctgcacatgggaagaagaaattgcgatcagattcttcgtcgacaatgccgcctggtaccagctctgctcccggacgtcaatatattcggtaaactgatcctctccctcatttaaaatactgcgcccattgtcggctaccaccgcgatattgtaaatatcattccggctgttgcgaatggttttaaactggcttataatacgttccttttcttcctgcaattcctcttccggctgctgcgtattatacagatagtaggaaacatcactgtttgccgcaatgatcgatgatatattcagcatgtaatccatgtaagaatcgatatcataattcacctgtttgataatctgggaggtataattgattgaattttcatagatcgtattctttgtaaagtttaatgcaatgaaaaggaaaatcagcaccgcaatcaccattaacacggaaaatgaaaccataatcgtgctttggatgctcttgaatctgccgaatatcgtcctgaattcttgttctttcttcatttgctaacgctccctggcatactccttcggagttttccctgtcattttcttaaatgcaatgctgaaataatgaggatcactgaagcccactttttctgcgatctcataattcttgaggcatgtctgccggaggagctgctttgcacgctccatacggactccggtaagcacttccgtgaaggttctgcctgtggcctctttgaaaagactgctgaaacggctggtactgatgttcagatagtcacagatatcgtttagtcccagatcctgattactgtaattttctctgatatagtccatcgcctgagccgccaggcgctccgcactcgtctgcccggcagcgttaaccgcttccatccccctggccgcatattcccggatcagcgttatcgccttgtccaggttccttgcatccgttataccggatatatctgaatccttcagcaaaaactcctcatctgtctcctgcaccgtctgacagatgatcctgagcacctgatggagataagccacagccttatttctgctcacatagccagaccgcatccagtcctcaacgtgatccaggatctcataaagtaccgtcccctcttttcctttcacggcagcggcaatatctttaaaatcctgttccagctccatgggattccccgagggcaatgcctcctcacagtcaaaaataacccctgtccccttggtataacggaacttgaggatcgctgtggcagaatcgtaggacttgtaaagctcctccagagaggcgacatagctgccgatccccatggaaacactcagtttcatcgcgtcataaatggtagactgaatctccctgcagatggcattcacctgccctgcatgctctttgggcttatttgtccgaaacaaaatacagaccctgttgtcggaatccctgtatgccagccctgcattatgattgttcacaatctcattgctgatgttctccacaacgaaggacatcagtgcgctttccttcttcaggtcgtcgtcaatctcatacagatcggaatacacatcaatatcgacggccgccacccggtaagatccccctttgatcgtgatgccgaactcctccagctcacgcaggcttgtctccacgtcctgcgtccccctgaccagacgcgacagcgccctggatatgatcaaggcttcattcttcgtatagctctgatataccttcgtcagctcatccatcttctgctcctgctgtctctcgccgtccagcttctccctgattctgttcagcacctcggacaattccttggcagtaaccggcttcagaatatattcggccactttatactggatcgcctgctttgcatattcaaaatcgctgtatccgctgaaaataatggtcgtagtctgaggcagattctcatggatatatttactcagccccatgccgtctatgtatggcatgcagatatccgtaagcacaacgtcggccggcgtctcctttaaaaattcgatcgcatccttgccgttttcgcagtcgccgaccagctcaaaccccagctgtccccattcaatctttgcgccaatcgcctcgcgcacaaggatttcatcatctaccagtaaaactttatacactgttttatcctcccgtatgagcatatttttcctccacatacttaggattagtatacaacaagtttcttcccaggggaagaggggcggcactggaaaattgcagtatctgaaaataaaggtgacagttcatgcctgcctgaactgttacaaataaagtttatgctcccctcccggtggatgcagcccagcctgccgtgagactgacggggagggagcgcaggacacatccgggcatttcggatgcgtagaatgcgcgttagaaccacgtatagcaaaacggcgccatcacatggattggatctgcttccgaagcagattcaaagccggcctgagccacggaattcatcagaattccacggtgaatgccggtggttccatgtgatggcgccattttgctattagtggttcttcgcaaatgggccgcatctgaaatacccggatgtatcctgcgcttcctcccccgtcagtctcacggcaggcggactatcccctacaaagtcacaataaccccatcctcatcccaaagatcatgccagtcttttgcgccttcccacaagaacacctgcccctttacaaggcggttgtttctctcaagagttgcaattttggccatctcctcgtcagtaagcggatcatctaacatactctttaagttgcttacatactcaacctcatgtacagagaacggaatcggaatctgccctctctgatgcgcccatttcagtgcaatcaacgccggatgcacgccgtgggcttttgcaatctcctgcatttccggtgtctgcaggtcagctacgtcttccggacacatatctctctctggtctctgcggggagcctaacggcatgaaaccaatcggctgaatattgtgagccacgagataatcgaataattcctgctgctggaagcatacatgaagctcgagttcgcatgccgccggcataattttcataagaggcagtacagcttccagtttcgggattgtcatattagagattccaatatggcggaccagccccttttctaccaatgcctcgcactgtctgtaagtactcataaactcttccacgctgaatggtttggagtccggatttctggagtccacatcgcatcctggtgcatgatagttcgggaacggccagtggataaagaacatgtcgatataatcacactgcaggtctgtaatgctctttctgcaggattcttctactctttcgtgcatatcgttccaaacttttgtcataatataaagctctttacgctctaccacgccttcatcaaatgcagctttaaagacctccccgatctggtcttcatttccatagcatgccgcacagtcgaacatacggtagccacatcggattgcgcctgccaccgcgtctgacacctgctgtgctgtaaatctgtcggaaccaaatgttcccattcctacacatggtacttcttcacctgtataaagtctcacttttggcacatctgccggattaataaattctcccatctttttgtctccttctttctctttttattttcaccgtataaatacatacggggatttttatttcatttttacgatccggatttccggaaaaatacgctccatatcttcttttacatagaaaccggtctcttctctcagggctgccgccgcagaaatcgcactcgcttttctcaataccccttccatggaaagcccttcgctcagccccagagcaaaaccggctatcatggaatcgccgcatccaacagtattcactgcatcaattttcggtacctctgcacggtatatcccttcactgcacacaacaaatgatccttctccaccaagtgaaacggctacaatctccacgccatcattatggattctcttcgcagcctctatcatatcgctgatactctcgcattcttgcccggtcagcatcctgatctcatctagatttggcttaatcatcgtcggttttgcttctattcccatctccaacagcctgccgcttgtatccagaatcacttttttccctgcatccctgcagaccttgaccagcctctggtatgcagttccgtccaggcctttgggtacgcttcccgacattgccacgacatcggccttagccgccagcccctggaatttttccagaaatccgctgaaatcctcctcggatacggtaaaaccaggttccagaaattctgtctgcacatggttcacctcatcccatatgttaatacaggatctgctctccgcctccatatgataaaatgcacttttaattccgaatggtttcagggaatcctctatataagcgcctgcatgcccgccgacaaatcctgtggcaaccacttcagcccccgcaattgctgcaggcttggaaacattgagcccttttcctcccggtgtgtaagcgcattctctgacccggttcacttctccggtttgaaagccctccactacatatctcttgtcaatcgccgcatttaacgtgactgtaagtatcatgaattcagccctcccaagctttacttaatcatttctgttcacaaccagacacgctctcgtttatcaacagaacctttccttttacaagccccggtgtcttaaacatctggaatgcttcctgggcctggctcatgggcatctttttatagatgaatccgggatcaaatttgagctgtcctgttgcaaaataatgcgccgtcagttcccactcttttccggggaacggagagctgtaggacatccaggaacctgtcagtttgaactctttgcggttcatgttctcccacatggccggtgtaaatgtaaggtctgcatggggagtcccaatgaaacatacatgcgctttatttgccgccagctcgaaggccatatacatcgtaggcgcctgtcccgcggtctcgtatacgtatgcataccccttgccgcccgtgacagccatagcttcctccatgtagttttcttttgttgtattgatcacttcatctgctccgagacgctttgcaagctccagcctttcatcgctgatatcaaagacaaccacttttttggaaccgaagatcttcgcccattgcatcgtaaacatcccaatggttccgccgcccagaatcgcaacatactgtccgctctggtagtcgttctgcaggaggccgtgcagtgcgaccgtagaaggttcgaacatagctccctgctcataggaaatactcgggtcaaatgcaaccgcattctgttccggtacgacaacatattccgcgttgctgccctgctgtctggatccgataaaactgtaatgcttacagagggagaaattgccgttctggcagtcgtcacatttcatacagggaagaagcggcgcaccggatacccggtccccaaccttaactttcgtaacgccttctcccacttccacgacatcgcccgagaactcgtgtcccagtacgatgggatagaaatgtacgccgttatgaagcaccctgggaatatcagagccgcagattccagaagctttcactttcaccttgacttcgcccggccctgcctggggctcctcgtaatccagatactgtacatcctcatttgcgcatactactgctgctttcattttacctgcctcctgtttttttcatagtttcttttaaattatgatatagttccagatatatctgatagttcttttcataaacggctgcattgtccgggttcggttcatgggaccgtctgttctccaccgtcagggcaactgcctcctcaaaactctcatacatgcccacacccacacctgcaagtattacagcgcccagtgttgtagccgtatcagaggaagggacgaggatcggttttcccgtaatatcggacttgatctgtgtccaaagcagtgaattggcagaaccgcccatggcacgcaatacgctgacctttgcgcctgcctcttccgccacatcgagattatgtttcagtgcatatgccacgccttccatggcagaccggataaagtgcgcctttgtcttgctgaaatccaggccgtaaaatacgccctttgcatccggatcccaaatgggagaacgctcgccggacatatagggcaaaaatacggttccgccgcttcccggagataccttttccgccatctcattaaacaattccagggagctttttccctgtctcttcccttcttccctctcgtagtctccaaactgctgttccagccacctcataacacccccgccgccggtagtgccgccctgaagcagccattggcccggaaccacatggaatcccagaattaatctcggatccgcctgatatgtatctgtgcagatgctcatgccgcccgcctgaccgccctgttcctgagtctctcccggatggataacccccgcgcctaaggttccgcacgccgcgtccagaccgcctgccaccaccggtgttccaacggccagaccgctttctgcggcagccttctccgtaactttaccgatcacctcatggcagggatggatttccggcagaaactccgccgggataccaagcctctcacacattttcatatcccacgttcccgtgtgcatgtcaaagcagtgcagcccatatccctgcgaaagatcctgggacatctcccccgtcagtttataggcaatgtaactgttggactgcagtatcttacaggttcgtgcatatacctccggcagatttctctggtaccagataatcttagccgttgtgtaagagggctgcagagaattaccggaaagtttgaatatctcgtctgccccgatcttctcattaagttcatcgcagatatccgcagcccttgtatccatccaaatcggtgtattcgtaagcacgctgccctcccggtcaaccgcaattgctgaccagctctgcccgtcaattccaatgccggcaatctgctccggcaggatactgccatgggacagtacttcttttaccgcagagcatatagcatcccaccattcttccggattctgttctgcccatcccagatgaggataatacaccggataactgccatttgccgcagctattgccttaccgccccggtcaaatacggcaatcttacaggcactggtccctatatcaattcccagtaaatattgttccatctctacctcccataccatccgctatttttataaacggaaatatcatatcgctctctatcgaaacgtttcggtattcctcaaaagaaaattctgtcatctgacagattttccttccacgaaggtcgtctttaacttcaccgtctccttctcttcctgcgctccggaagcgtccagcctcctaagcatcagttccgacacacagctgccaatctcctttgtgggctgtgccactatactaagcctggggatgcttgccttggcaaactccacattatcaaatccaataaaagaaagctgcccggggatctcaatccccagctcgttaacctctataatcgcacccatggtcatctcgtaattggaaacgaatactgccgtcatatgcggattttttctgaacagttccttcatggctgccgcgccgcccttaatcgtgtaatcgccgcggaccaccagcccttcgccaaaggcaacgccggccttctccatagccatacaatagccccggtaccgctcttctgcggtatagatttcttccggtccggcaatcatgccgatcttcctgtggcctgccttgagcagccgttccacagcatccctggccgcaccttcattgtctaccagaacacagtcgcattccatgtctttgagttttcggtctaccaacaccaccggttttccggcccgaaggaacttctgcagatatacacccctttttcctgagggcataatgatcaatccatccactcgcctgtgaagcaaaaactcgacagcctcctcttcacgattttcgtccgtacggcagtcgcagatcatggttgcatatccatggcttctaagctgatcctctacttccgtgataatctcagcacagaaaatattgttcagctccggtatgataattccgattgttttcgtcttatttgtcttcaggcctcttgccacctcgttgacttcaaagtgaagctcctctatcgcttcctctatcttgatccggttcttctcccttacattgcctccatttaaataggaagaaattgtcgccaggccaagtccggttttcttcgcaatatccttgatcgtagctgccatggttatccctgccttatctgcccctgtgccgtgcacagaaagactattttacgttcctgttcaaaccgtgccgtgtacgcccaaagggtgtgaacaggaactatttcactttatggtcacatccgcataccttcatgcgctccattaccagattcttcactgcttccatacccacaatgccgagtttcttaggatcaaaggtatccggtttctcctccagaagctttttgcctgcgtctgtataagctaccctcagctctgtggcaaagttcactttgcacatcccgcgctccacacactctttgacatcatcatcgctgaggcctgacgccccgtggagaacaagcggtacagagactacctttctgatctcggaaactctttctttatccagtaccggagtacctgcatagaatccgtgagccgtcccgattgcaattgccagggaggaaaccccggttctttccacaaattcctttgcttctgcaggatctgtattggtatccgcatctgcttccagatcgtcttccttaccgccgaccttccccagttctgcttccaccggtatgccacatgctttggctgcatctaccacctttttgctgacagcgacattatcttcaaagctttcgtgtgagccatcgatcatgaccgatgtataccccgccttgattgcctgtaccgccagatcaaagctgctgccatggtccaggtgtaaacatacaggaaccgcagccttttttgcttccgcagcaacgatcccaaaataggtgtccagagaaccgtacttcactgtggaaggggtcgtctgcagcataacaggcgcatgcagttcttccgcagccgcaatcacggccttcaccatctccatattctccacattaaaggcacctacagcataaccgcccttctgcgcatccaataacatttgttctgatgtaactaatggcatatgtattatcctccttagggttaaccgaaacgtttcggtttatttatatttatataataatccggttttatcagaatgtcaatccccagttttcaaaacattgtaatagaaaaaatttaaaacttttacacggataagggcgtatgtgattcttaagatagagaaaggggaccgtctgtttcccgactgtccccttattacagatccaatacataggtatgatgtttaactcagtccaaatgaaatacaggataaagatcggtagatacaggactattatccggattggtctccatgatatccgccatatagtcccaccatttacggcagatctctgtgtccgcgctcttgtcccatctttctgcgtcttcgagttctatatagccatacagaatatccgtgtccttatcgaggaagatcgaataattcgatccgccgtattcatggatcatatctctcatctccggccacagttggttatggcgcttttcatactctttttccattcccgggtataatttcattttaaaactttttctgatcatgttgtctcctttcttgtctcggcattcttatgtacatgccctttgtgctgcttccagaatatcacttaccacggctcctgtctagttcaaagagcagcttttgaaagccataagaaatataagcgggcaaaaaccgcccgcttatatttcttatctatggagttgtaaaattctagtaaacatctttccactcgtcgatgttagaaggatcaaatttgaacggtgcgccaaggatgacttctgttccgccgtcggacgcttctactactgtgtagtcgcccatatcgccggctgtgaatgtgtcatctactgctcctgtaattgttccgtcaactaatgcgattgatgtgtaagccccaaggcgtccaacatcgatcggattccacagatacatatacgggcatgaatgggcgtcgtcatcaccgatgtattcagccatttctgaaggcagtccaagtcctgtcagttttacagatgatttctcgtcctgaagtaccttagctgctgcattgataccaacagttgtaggtgcgcagataactttcagatccggatatttggataacagagcctgtgtctggtctgttgatttctgtggctcgtcatctccgtatgcaacttctacaagttccagtttggagtatttgtcttctttcatgatctctttcatagcgtcgatccatgcattctggtttgttgcctgtgatgtagctgaaagaattgcccactgtccttctccgcctgtgatgtccagaacagcgtccatcagagcctggccgatctctgttgttccagcctggtttacaaatgtctgacggctgtcagggttcgctttagagtcaaggcaggatactttgattcctgcgtccattgcttcttccagtgctgcctgaagtgcattctcatcgtttgcagcgatacagatagaatctactccctgagaaatcagtgactggattacggatacctgtgcatccgctgtagcagcctcaggatgttttacgatgcattctccgccttctgcctcgattacttcctggaaaccttccgcctctttttcattgtaaggatttcctgctgattttgtaacaattgcatacgtcttctttccggaatcactgccgtcatcttttgcagtatcctctgtctttgcatcagagccgccgtctgcagcgccctcatcctttgagccgcatcctacagccagtgttgccgccattgctacacataacagtacgcttaaaacttttttcttcatgctttctttcctccctatggaattttattgtatacaaagcgcctttcccgacgcccggtatcagattaataaaaacaagttattagaaacaaactacttaactgctgctgtttttttctttaactttaactcgcctccgatatttggcagtaatacggccagaatcagcagagcgcctaatataatcagaattaactgcgggttcatgttgatctgtccaagaccaattctcaggcagatgattatgaatgcggaaatgattcctccctgtaacttacccttgcccccggcggttgatattccgccgaataccgccattgcgatggcatcaagctcaaatccgtttcccgtcgtggtgttggctccgtaaagcacggaagtgaggaagagcgctgcaagcccggccatgaaacccatcaccatatagatgatcaggcggatcttctgtacatggattcctgaatagtaggctgccagccggttggatccgatagcatatacactccttccgaatgtcgtcttgctgagtacaacggtaaaaatgactgcaaatatcaccactacgaagaggatatatgggatcatccccacttttccggcgatcatgcggaacccgtctgcgttgcttaatgatatggacccgccgcttccaagagcgatctctgcaattcctctgaatacgatctgcgttcccagcgttacaatcataggaggcaattctgtaaactttgtaaggatcaggccgttcaccagtccgcagaccgtgccgaccacaagcgcggtcagaactactaagataaacggcatatctttgttgcataccatgcatgtcatcgtggctgacaggcagacggtagcgcctacggatatatcaatttcgccaagtatcaggatgtatgccattggaagcatcagaaacacttctgtcagatatttgggcatctctctgaggacattggatacctgatagctctgggagatacttgaacaaaaaatgttgattacgataaacaatactaccagcatgccttcccaactgagaactgtctttttccatgacttctctggcacattggctatagttcttccggattttcctgccatgattacatctcccttcccttcagattatttttatccattacacgctgtgttacgacgttcaggattacgacgactaatatgataacaccctttactgtattctgtgcaatcgagtcgattcctacgagaggaagtgcttttgcgataatcgccaggatcagggaaccaaggaatgctcctacaacacttccgcgcccgcctgtcatgctgacaccgccgatgacacaggcggcgataacatccatctcttttccgtacagcatgttgggctgtgcggaagagtaaaccgctacggccagggcaccgcacagtcctgcgagaattcccattaccgtataaaccatcagttccacattggacgtattgataccggatattgcagccgcctcacggttgctccctaccgcatatacttttcttcccaccttcgtccatttcataacaataaagaatataatataacatgcaaacatgattaatacaacattattaattcccagtaccttacccagggcaaagtttttaaactcacccaggttttctgcacttgcccactggctgtttccgatcatataggccatgccccggtatatgtacatgaatcccattgttgcaatgatcggaagcacctttccttttgcgataacaagaccgattaccagcccgcacagcgctccgattccgatcgcaatcagaaagagcaggaaagcattttctacgatgttatatttcagcagcatcccgaccgtcatcccggaaaatgcaagcgtggatgcgattgagatatcgataccgccgagcagcagcactcccagcattcccagggtcatgatcatgataaccgcgttatttttcagcatatctgatatagatttcagcgtcatgaaggaagggcttctgaatgaaatgaccacacagaggataatcaaaacgatcagaagacttgcttcacgggagccggtgatttttttccagatagatttattttctttcatctttcccatttcctcctactttgatttttccatcgccagctcaagaatgccttcctgagtcgcctcatcacggttcagttcaccagttacttttccgccgcacattacgacgattctgtcgctcatgcccaggatctctggcatttcggaggagatcaggataatcgcgtatcccagttttgccaaatcgcccatgatctgatagatctccgccttggctccaacgtccacaccttttgtcggctcatccatgatgacaaccttcatctcctggccgagcgcctttgctactacgaccttctgctgattacctcctgagagtgatgtcgcaggatcgaatatcgtaactgcttttgtatccacatcttcgagaagcttcttcgcaatttcgcgttctttcttctcgttattaaaaccatgctttgcatatttgcccatggtcggaagtgtgacgttcctgcccaggccccagctcatgatcagtccttctttctgacggtcttcgggaagaaggatgatcccctgcttcatcgcatcggacggctgtttgatatgtgtttccttgccctccagaaataccttcccggcatccggctttgtgataccgcagacactttccacaacctcggtccgccctgcgccaaccagccctgtcagacctacgatctcacctgcatgcacgctgaaggaaacattcttgaaatatccaagtctggagagtccctccacccgcagtacttcaggtccgatctgcacttccggttttgggaacagatccttgatctcacgtccaaccattgctttaatcaaatccgcattggtgattccgtctacatcataagtgccgatatactgtgaatcccggaacacggtaaccgtgcttgccaggcggtacatatcctcaaaacggtgggagatgaagatgacagaaacaccgctgtctttcagcttatcaacgattcggtatagttcctcagactcattcttggtcagcgctgcggtaggctcatccagaataatgattctggcatttgtagaaagtgcctttgcaatctccaccatctgctgctgtgccacgctcaaagctcccatctcatcggtaggcttaaagtcggcgttcagctgcgacagcagcttgcccgcttcctcattcatcttcttccactgaatcatgcctctgctgatgatctcgtggcccatgaagatattttctgctactgtcaggtccggataagatgtcggatgctggtaaactgccgcaataccggctgcctgtgcatctctggggcctttgaagtcaaccttcctgccgtccaggaacatctcgccttcttctgctttatgtactccggttatgacttttatgaatgtagacttaccggctccgttctcgcccatcaatgcatggacttcaccctttttgagctggaaatgcacattgtccaaagccttaacgccaggaaatatttttgtgataccttttaattccaaaacatattcagacaccgtgtttccctccttttcctttctaaactaagtgtaacagttctaaacttctaccaaaacagcaaaatttttcgattaagggtaaattttttttgtattagtcttcaggcaaattttctgctcaagcagaacattagggtatacccaaagggcaccccgtaactcatgccctaacgggcgggtctgcagcaagctgcagaataaagtatagatttcacagatggattttgttagaatgatagcatatagtatgaatatgatgaaacttctattttcgagggagtccgttcaggagcccctgccagcatgcggattcccccctgcccagaacatcagggcataggacgatctgattacgaaggagaaccgatacgatgagattattgattgtggacgatgaagagttaacccgtgaaggattgattgcgtctcttgactggaatgcactggggattgagcagatctttcaggccgatgacggagtgaacgcgctggatattgcccgcgcgcagaaaccggatattattctatgtgatgtccgcatgccgcgcatgaacgggattcagctggtcgaacgtctggaagagtttcttccggataccagcgtcatttttatgagcggttattcggacaaggagtatctgaaggcggccatcaaactgaaagcgatcaattatgtagaaaagcctctaaacccggaggaaatcaaagaggcagtgttggaagccattgagcgccgtgcaaagaatctgcgcaccaggcagaacgaaaacctgtattctatggagaccgcctcccatcttgcactgctgctgaccaaaccctataaggagaataccgggcagatcaccagccttgtcgaagagctttctctccgcctgatgccgggaagcagttttacaacctatatcgtcaggctgaaacccacggaacctgacggcacacttctgcgcaacatccgggatgacctgaccgattatcttacacattatcacctgcatgtattttacatccagatccacgccgtatatcatgtgtttcatattatgggagacagcgcgccctccccaattgccctgtctgctgttgagaattttctgaaagagcagtttcttcccctgggtgatttttttatcgggcggggagacacggtgagcggaatcagtcgggtctatcactcttatacgaccgcggtggttatgctccaaagcagtttctttttcagcccgggtacgcttcttgctgcatcagacatggaaaacgcaccgggaatggaaccaggcgcacaggaacagacggaaaagattgcggcggactttaaagatgcgcttcttgccaaagatcaggctgcctgcatcggactgctgagccggctgtatcggtgttattctgaaaacagggtgtttcttcccaaccaggtaaaggatatttactataaactttttatcagtatcaatgactgccgccagacgctgaaactgagccatgatccttcggagaccagtacagaggaaagtatcattgaccatctggaacgctgttttacttaccaggagcttcacgagctgctggtctccagaactgagcagttttttgcaggcatcagcgaccatgttccggaagattccacgatttttctgatcaaggactatatcagccggaattatgccagcgatgcgctctccatcaaggagatcagcgaccatgtatatctctctgcttcttatgtctgtacctattttaagagccagacaggacagactctcaatcagtatctgactgagtaccgcatggaaaaggcgatgcagctgctaagtgacgcccgctatcagatcacagatatatcctccagggtcggctacagcaatggcaattattttagcaaaagctttaaaaaattcacggggctgaccccgtccaaatacagggagaagatgctgggatgaaattacatacaaagaaaaacggcagtttatataagaatctgaagcttcagaccaagtttacgattacacatttggtgatcgcaacgatccccatgatcgtgcttgccatctttttctatacgaaactttatgacatgatcattgcagacaccatccgtacggagcagaatgcatccacgcagacagccccgctgattgaggatgccgtttcccgcatactccggcttcatgaccagattacaggggaagagttctaccatcagattgtcagctccgcccggacagaaacactgagcggccttgcagatggtgattctgcagacatctttttggagacaatcaaagaagccacggatggctctctgatcacagatgtaaaactgtatatagatattccacggacagatcgtatcttttcaaattatccgatgtgcaataccatccttccgatcaataatgcctggggaacctactggtatgggatatttaacggggctccgtcgctgcgcacgcttttctgtccgtctttctatcttggctcttatgagatcaggcataacggggaaatggcatacataacaaaatcgagtattatttatgagggcaaacgggttccctgctacctggcgatctatttttcccaggactatttcgacagcctgttaaaagacaacctgtcttccagcagcaacgtggcttacatcatcaatgacagggacagtcttgtggccacatcggatccggcattatccggcgcctatcatttcggatatgatgaggtgcaggaacattttatgtcctccaataactttattttaaagcgggttctgggggaggacgtatacgccggcttttacagcataaaaaatacggactggtacatggtcgtggccatgccgtcccagcccatgattacgaaaagtattacgattatggcaggctttatcctggtttatgtggcgtgtatcctgatcgcattcctcattgccacgctgctctcccattccattacgaacaggctgtcagccgtcatcaatcagatggcaaagtcgcggatcgggccgcccgtggcactgcctgacgcagacacttacgatgagatcggggatctgatctccacctataattatatgacccgcgtgattaatcagcttatggatgagcaagccaaggccgccgaggatctgcgggtagcggaatttaattctctgcaggcccagatcaatccacattttctctataataccatggatatgatcaactggctgtcccagcagggccgctcccaggatgtaacctccgcggtccagaagctatcccgtttttataagctgacgctgagcagaaagcagagcctcagcaccatagcagatgagctggagcatgtttctatctatgtccagctgcagaatatgcgtttccatgacaccattgattttctgatcgatatcccagataatctactcgagtactcaatcccaaagctgaccttccagccggtcattgagaactgtgtcctgcacggcattctggaaaaggagtccaagcagggaaccatcgtacttaccggatggctggaggaggaggatattgtgattctaatttccgatgacggagtaggcatctccgaagaaaagctggaagacatactgaccggacacggctcctccggtggaaaaggttcgaagattgcggtctataacacacaccgccggctgcagctgatgtacggtccggggtatgggctgacctattccagtacccgcggcagcggcaccgaggtggagatacgtctgcctgcacgctatccccaggatggaatcgcagatgccaaagaagaaagcagtccggaggatctgctgaaagaaagccattttatccaggctatgaccctgctgtcccgcccggaaataaatatatacgagattgcctcggaatgcggatacaacgacacacaacagttctttaacgaatttaaagagcggttcggttacacacccgaagaatacaggcgccagatgctctaaactcacaatcatgagtttgataagccggtcccgcgcctgttgatcttccatatacttttatttatccaataccactgccggtatctcaagcaaatctgcaactttctcataaagggatgcattgtgcccgatgctcattgcaaaatgatgtgtcggcgcctctgcaaaccattcatccatataagaatccggatcctttttgaacttaacaggggtctgggtgtttcctatagtcatgatgtcgccgtccgtcgactccgcctccgtgatgataaacttgagctttccgtccacggtctgggtacatcccaggttagtaatgtcgccggtgcgcactttggcttccacagatacgccggttccctgtttcccatggtacagccccatccctcttaagattggctttccttttgcgatctccagatggaacgggccgtcatgccccagaagaatggtgccgtcttcataatctgccgtaacaatttcacagaagctcccgcccttaccaaggatgtcgcatatcttcatcgccaggcaggttttcaggtctccctccccggcgcacggaattcccctggctgttaaaagagaatgcccgacaataaagcctccctgcacctcttcgtaatgccctcccggcgccccgtgataataataggtcaatgcatccagaccgaactcttccaccagtttctcctgtgccacagccactcttgccgaccagttcatctgctcatccgtcggtttctgggcaagagggtctgccgccgcatcttcgcttatcgtaaaaaacgcctcgatctcctttctttttgccgctgtctcttcttctgtcacactttgcaggtgcctgtccagatcacacatttccaatacctgcagatgggcgccggtctgtgcctgaaacatggtaaaatcgctgtacatatccagcattccgctgtaggtattgccaaggaacccaaaccgggcccccttgaggccgcattttactttggcggcctgaacccactcttcaatctgcctccacgcccgcttcgcctccgggcgctgtgcagtatcttcatcggcaagagatatctccggagtatagtccagtcccaacaggccgtttacaacccggtatttgattttggcacggtggaaggcattggaaagctcaggcaccgggcacgcaccgcagtgtgccagccattccccggtcgtcgtcttctcataattaatctttgccgcaggctgcaggtttagaatcacgaccggtgcgctgcagatctgatgcagcgggagcaccgatgcactcgtaacataagtcgcggaatgcgccagtatcagatccacatggttctcattgaaatactctcccgcttttttcccttcctgttcacagtccaccaatccatagaagcaggtatctgccccgaattcttgtacttttcctgcgataaattccccatattctatcagccgttcccgcagccccggaaactgcccccagtaatgcttcagtcccatggaataaattccgattcttggtttttttacttgttttcttgaattcatcgttttcctcctgctttcatgataaaaataatatattagtattgtttctatttatgtttacaaacccattatattcctgtaaaatagagattgcatccaagcaaattgtttaaaaataacagaatgttgtggtgacattatgagacagaacacaaaggttttggagcgcggctcccacacctggagtgaagactccatccggatgatactcacacccagcagtacggcacggtccacctacttctatacgcaggaggtaggttattttaagacgttccatccctatttttcggaacgggagaatctggactccttcctgatcgtctacacggtatcgggcaaaggatatctggaatatgaagggcagacttatccaattacaaaggggcagtgtttttatatcaactgcgaacagcaccatctgtaccgcacgggccgggaggaagactgggagatcctgtggattcattttaacggaaacagtgcgttgggttattacaaggaatttaccagaaatggatttcagatattgagcgtgcgcgacgaatttttcatggagcgcacgctctggcgcattattgcgctcaatcaaaaaaaggatctgaccaccgagctggtcacatccaatttaatcaacggtatgctgacagaactgctgcttcagacagctacaaataatgcagatacctttctgatcccggattatatcaggcaaatcgtgcgggaaatagataagaattttaaatccggcctcccgctgtcatattttgaagaatttacccaccgcagccgctattatatcttaaaagaattcaaaaaatatatcggcgtcacgatccatgaatatattatcactgcccgcatttcctatgcaaaagagcttctgaagtattctgatcttccggtcagtgagattgcctttgaagccggaatgaacaatgtgactcattttattaatctttttaaggccagggaaggcgccaccccactggcatacagaaaggcatggaggaattaaagcttgcataccttttttacttataagaaagttggtctgtaagataaaaagcccgcccggcgggatgcgcactgcggcgtaagcagtagatgccgctatgcggccgcctcaggcacgagtttctctagagaaactctattcttatgatataggaaattcctctgggatttcctatatcataaaaaccctccgggaggatgcacacgccgcgttaaggtatatagctgcaaagcggcatcgcggcggcgccaaagcgtgcaggcccctcatgagtgaggggtttaggagttgaggcgggcttgcccactttgttctatccgcctgctcccatgcacagagcaggaatactaaagtttctaaaactcatactttttttgaggtgatttcaaaatacaagcatactgatctgcggacattggcctggcgcaataatatccctgtatgtcatctatcttcatactttttaatatatcatactgtgctttattttctacgccctccgctgttacgctaatatgaagcgactgtgcgagcctgataatactgctcaggatcagtcttaccttttcattgttttccacgggatcgaccatactcttatcaatctttagaatatcaatcggcatagacttgagcatcgtaaccgatgaatatccggagccaaaatcatccattaatatccggattcccctgctgcggagttcttccaggctatcagagagaatatcttcattggagaacagtgccgtctctgtcatttccagctgtatcagctcatgcgggatctgatgccggtcaatgatctccagataccgttccacaaaatttagcctgtataaatgcagctgtgatacattaaccgagacaggcagaacttcaatgccctcccgaagccaccgttgtatctggctgcaagccatctcgagcacgaattcatccagttccacgatgctgccactgtgttccagaacgggaataaactccgccgggctgatagcccctgttttaggatcttcccatctgaccagagcttcggcgccgcagaaccgttgctcttccacctggaatttgggctggtaacacaggtagaactcctgatttttaagcgcttccgaaaaacggtcctctagctctttattccgcagcatacggctgcggatggtctcgctgtaaaaattacacgaattaatctccgggttatattccgaccgcgccgccatagccgaccggtccagcatggattccagcatttcctccctctgctgcaccatatagaccccggcctgtactttcagcacataaggggtatccccaacgcggttatcggcctcacattcaatttttttcagaatcatatccaggcgctcctgcaattgtttctgatcctggtataccagtaatatggcataatgatcagactgcattcttgccgcacactcataggttccgactgcctccctcaacgccttcatcacacgtttcagtgcccggtctccctcttcatagccatacaggtcattgatgtactggaacctttttatattcaatacagcaagggcatactttttatccgtatatgtatgcagaagcttctgggcatccagcatgaatttagcgtacgaagcatctccggtaacttcatctacatacgccgcccgctccagcatcttcctgcccgccttctggatcaggtacaccctgcatgccaaatacaggattccaagcagacacaccagcaggatcgcataggccgtagccataggcccattgatatgagtctcaactaccgcttccggtatcacgctcatcagataccagtcattgatctccagaggctggtaatatacatagcggctgccttttttcgtctgaaaagtcacgaatccgtcccggaaggcatctatatcttcctgaagccgccgcatgcccgccctgttatcctccgattcctccagaatataatcataataattctcaaatgagctcccatttttgttttcagagtcaatgacacagtccccattttttcgaataatgtaactgtacccttcccctccgaatgtcgatacggacaaaatctccttataatactcgatctcatatgctccgaacaaaacataccttgtaccatcctcccaattaatcggagtactgtaaagagtaatatctttcccgtcatccaaatccttgagacgatccgaaaccactgtttccccttccattgcagcctggaaccgctcctgaatactctcccgatccggcacaaatcccctgccatcggtagccttcccaaagtaatcatcccggataatccccatccgcttaaacccgttcatcttatccacattcacaagccgctcaatcagcacatcaatatccttcgttcccccctcactaatgtaaattgccagattcgttaaaagcgtcttattcttttcaacctcctcctgaatcacattcacgctctgacaagatatctcagaaagagtattcaaaaccttcccctccgaagactgctgaaacttccacgtaaaaaagactgccagcaaaacagtcatggcaataacagcaataatatcaatatacaattttctttgtcttctgccttctcttttcatatcccaattatacacactccccatccccccgtcaaatgagattagcgagcagattatgcgagcggaagatagggggcgcctacacataaaaagctctccccagcccataaaaccacgccatcgtctgttccatccacagctcccgcacaaggcccctcctcccccaaccgttaccagaggtttttatagatttgtactacatccgccttccgtggcacgcgtggatttgtatccgtacacccatctgccattgccccatctgccatatgatctatggcattgaagtactcttcttcagagattgtccccatctgtgatatggagagcggtatatccatctctttcagcatgaactgtacccagtttacgagtgatcttaccgtcatgatcttattataactgctcagtcccagcagctgtgccactgtggagtatcttttcacagccggcaggtactccgtacggctcttgctgtgcttgttgatatcactgttgaactcaatgatatggggaagcagcattgcgtttgcccgtccgtgcgggatgtggaatgttgcgccaagctgatgtgccattccatggtttagtcccaatgacgcggagttgaatgcaagccctgccaggcaggatgcggaatgcatcttctggcgcgcatgggtatcatttccgtccagatatgcacggagcaggaatacgccgcagatttcgattgctttctctgcaagcgccgttgaaaaatcatttctgtttgtgcttacacaagcctcgagcgcgtgcgtaaatacatccattccggtgtccgctgtaattgaaggcggcacactcttaacaagctcggcatccaggattgcctcatccggtgtcagatctctggaaaccagagggtatttcatctgttctttcggatcggatacaaccgcgaaggatgtaacttctgaaccagttccgcttgttgtcggtattgcgatcaatccgacttccccgtaattgtccacacgaagtgcaaactcacggattgatttggaggaatcaatggcagatcccccgccgactgcgacaatcgcgtccggcttatattccagcatctttttgacaccttcactgattttttcgatcggaggatccggcacaacatccttaaaaatgtcaaattctatctttccctttttaagaggatcggtaatcagattaatcatactgctctgagccataaacggatcagtgattaccagtaccttgttgtatggaatttctgccaaacgatccagcgcctgatcgccaaaatatactttagtcttaatctcaaagcttttcatagtgtttttcctttattccgggtagatgcactctatccctaactcttcaaatgcctgaagccatttggcctcgggtttttcatcagtaacaacagtcgttatatcttccagcattccgatcgctgtaaacgcaatttgatcaaatttactgctgtctattgccagaatcttctgttttcctgattccagcatggttttcttgttgttcgcgtgaagctcatccgaatctgtaagaccggaagcaaggtcaactcctttacaggaaattatcgacttatccacgtgataagaacgaagcatcttatccgtctgcggccccacgagcgcaaatgaaccttccctggatacgcccccggttgacagtacgctccagtcaggcacatcaaacaattcaatgataatctcaattgaatttgtgatcagcgtcaggttttttttctcttttaatgcctttgcgatataaactgctgtcgagctgccgtccagcatgaggctgtctccatcgtggaccattttgttcacaagttctgcaatccgctgttttccaacaacattgcggttctttcggatattaaatggaagatcgatgttcacattttcattgataactgctccgccatagctttttatggcatagccgtcattcaccagtttttccagatcccttcggattgtctcttcagacacatcatatatctggctcagctcacttaccactacacgccgttcagcctgaagcttttctaatatttcattccgtctctctattgcgagcatcacattgcctcccggtcatattgccctgccttgcccttctgaacacactgcagcgggctatacagcaaatatatgtttcgaatcatgcagctgtgcagttaatgcacaattttgtgctgaacaattgcgaatgattataatatcgcttcgcggatctgggcatccgggtgcgcgatcacagatgaatccaggtacattccctggtctgccactgcagcctttgccctctcgatagcagcttctacggctgccacatcacctgtcagcatcagataagatttcccacacattcctctggcaattctgagttcaatcagatcgacaatcgctgtcttcgcagcctcatctgcagccacaatgattgaggtggcatcgtaagtctccataattccgagagcagatacatcttcgatcttagtagccccatagattgccgggaaaatggatttgtgcgggttgccgagtacaaaactgttgatcagatgtttcccatgcagggctttggaagtctcaaccgcagcatttaccgcgctcaaatctcctgagataattacgatatattttcccggacatactgtctgggcctcaatgatactaacttcagaagtctttaccatagcatctgctgctacaacacctgctgaaacagtcttatattctaccattccaattgccttactcattgcctgcacgtccttcctgcgtttctatgattatatatttctcatttacttcactaaccgtaccgtctatacttgcatgtattcccacactcaagcctttacccggttcggctatcatctgtccctgcgttactttatcaccacgttttacaatcgcagatgcaggtgcgcctatgtgctggcttaacaggatcttcacttttcttacaggaactgcagtctcatcaagaggcgcctccctgtcatattttgtaagatccagtcttgccataaggcgttccatcggcaccttacggtactctctctcttcccccaccggtttgggtataacaccctgcggaggtttgagtccgttggcacgcaggcccgctttatattctgccattaatgatctcggtgacaatccctgcatacaggaatacatttcgcacagaccacaggaagaacaaaacatggtatttataaatatgtttggttcctgtaaatctttacaggttgccgcacgcataaacaaatgcggctctatcggatgtccaagccggtttctcggacataaatccgtacacatcgtacactggcagcagcaagccgctgcacgttttaaatcgatcgatgattttcttcttttcttttgaataatcaggtgttcctccggcagtaccagcacggcattagtcgtcttggtaaccggctgtgaaccgctgccgataaatcccatcatcgggcctccgatgaaatataccggatccctggcagtgacattgccggccagcctgacggtctcttcaatcgtcgttccgatcggtacccgcaccgttaccgggcgctctacctcagccacgacagataccagcttatccgttaccggcgcctgctggttaagtgctctgtatacgttgtatacagtctccacattgaatacggctacaccgctctcaattggaagccctcccggccttactactttaccagtcacttcatagatcagaacaacttcgtctccggccggatatacttcatccagcagcccaagcctgacctcgggatattcaccgatgacttcttccagagcctcaattgtctttttataagcctttttaattccgatgactacttcttttgcacctacaacctgccccatcatatggaaggtctcaacgatttcctgtgcatacttctcaagcagctgcctgtgcagccgaagaagcggttcacactctgcacaattcaggatgattgtttcagcacgttcatctagctttgcatatgtaggaaaacctgcaccacctgcaccaactataccgtttaactgcaatatgctgctcaattctttcatatccatcatttcattactccagtcctgttccatcgtcaataattccaacaattgctgcatcaataggtgcatccggcattccggaaccaattctggccgcgctgccctgtgctaccaacacatactcacctatacccgcaccaatcttatcaatcgcaatcagctgattcgcaccattctgcatatgctccaagacatccacaatcataaacttattgccgaccagattctcacatttgcgtgttgaaacaacacttcctttcacttttcctatcagcatagcatcctcctcttgcggctataatcttcagtgtttgatactagtacaattaccccgcacagacggcgcgtcagtgccggaactgtccggtaccggaaaagcctgcgggatgaatccccttcgtctgctgcggggtgttttacttaatgattcttacggtatctcctgtcgcaattttcgctgcattcgcttcatctgtatcgatatgcatctcaagagtaaagctgtcgtcaacgcggatctgaacatggttgaatacggttcctctctcgttgtctgccttcacagatacaatgtccccatcatgaacaccggctgccattgcatctttcggtgacatatggatatgcctttttgcaataatgcatccttcatccagataaatagctccttttggcccaacgactgcaattgccgccgagccggcggtgttgccggattcgcggatcggcgcctttaccccgagacggatggaatctgttgcagacacctccacctgggatttgcttcttacaggtcctaagatcctgacattctctatcgctctaagcttcaggccgacaattgttaccagttcgttcgatgcaaactggccgcccatcagctcttttttcttcgtcaactgatatcccggaccaaacagggcctcaacgtgctcctgtgtgaggtggatatgtctcgcggacactccgattggcacaagatatccggtatctccggaagctttctgcttctcaactgcttccagtaccattttggtaatcaatgctacattgttattgtccatatcaattctcctcattaagtattcacaggccttacgcatctgcctgaggaagagacgtaaggccgtaaatctttagctgaacttatctgttcaagaacagatactccgcatacccatgaaaatcgcctgcagcgatagggcttgcttttggctgttcagcgctttcgtacatactgtgcagtaaatacacagtcctgtactgaacaatacactaacgcttattatttcactgctggaagaattttttctacatcgctgtgtggtcttgggattacgtgggttgctactaattcgccaagtcttcctgctgcctctgcacctgattcaactgcagatttaacagctccaacatctccacgaaccattactgttaccagtccggaaccgatcttctctgttcctactaatactacattagcagctttgagcatggtatctgctgcttcgattgatgctactaaacctcttgtttcaaccattcctaatgcttcctgtgacattcttttttcctcctttaattgaatcttttcttctacctgttctgcttgctgcgccgactgtttcacccgctggatggtcttggccggcgccttcgcagtcgtcgtttttctggcggatgcagctttcgcagtgccagctgtctttttcgccgtgctttttgaagtgccggccgccctggctgtgctttttttggctgcaccttccggcttggaagtgtctggtgctttctccccgccgcttggtttattatcttctgccatttaactgcctcctaacttacccggttcgcgctgttattgatcagcttcagtatctccccgtgaggatttgcaatcaccacatgcgctactggttctttaattccgtttgcagcagcagtttcaatggcttgcgatacagctgatacgtctccgcggataatgatggttacaagtcttccacctaactttttttcccaggtgacaagctgcacttctgctgtcttgcacataatatcaatggcaaccaccgccgctgtcacacttgggatttcaaaaaatccatacgcctgtcccatgagactgctcctttactcattcttcttgctgctccctgttgcaatgacaggaagaactgcagtcatcttcggttcctatacagtaggaagaattttctctacgtcgttgtgtggtctcgggattacgtgtgttgctactaattcgccaagtcttcctgcagcgtcagcgccagtttcaactgcagctttaacagctcctacgtctccgcgaaccataactgttactagtccggaaccgatcttctctgttccaactaatgtaacctcagcagcctttgtcattgcatctgcagcctcgattgctgctgtcagtcctcttgtttctaccattcctaatgctaattgtgccattttcatttcctcctaaacttcttttacatagattttatttggtttgcctttatctaaaccgctcagcttcagcatcttttccgtatcctctgtgggtcttgcaatttcgtattcagctacaactcctgcaagttcttctgctttcattttcgctgcgtctaatgctgcctgaacatcggatacgcttccgcgaaacttgatcataacaataagcggtacgggtaattcatctgcatttgccggtttattcttgtcaaaagtctccagactcacatcgcccgctttgcatccggcatccgccgccgcaaatgctgttgccagtccgaatacttccaacatgcctactgcttctcccatgtcaattctcctttttgggattgctgctatttattaacaatagcgatcttcagaccttccatcttcaggttcgtctgatgagcctcgttgatctgatccagcgggaattcgtgtgtgatcaggtcatccatcggaagtccgattccttttgctctctttaggaaatcgaatgttgtcgcataatctcttaatgtatatacccaggaaccaactaatgtgatttccttagagcacaggtcaaaatgcgggttgattgtagcgtctccgccgttgatgaagaatcccagttcgcaaagcccgccgccgttgcggataaacttataaatgttggcatgtgcaaccggtgatcctgtacactggaatgcgaagtctgccggatgtccgtcaaacgctgccttaacgccgtctgccagagcctcaatccccttgaaatccttgaagtttacagagcgctcagcccccatcttctttgcaaagtcgagtctcttctgctctccgtctacagctacaatgttctcgatgcccattgtgcggagaactgcgatacagatcagaccgatggggccgcatccctgtacaacaactctgctgttgaatctcaggattcctgttgtctttgctctctctacagcatgaatcagtactgcacatggttcgatcaggattctggacttcaggtccaggtcgcttacgttgaatacggtagaaccctcacggatcacgatgtaatctgagaaccagccgttcagatgaatgtcatcatccgggagaagtccgtatacatcagcgccgcctacgttctgtttgttcagatcgtacattgtgatgtccggatcatccttgaagatcatacaggttacaaccttgtcacccaccttcagttctttacctgcgctgtcgatctttacgttcttacccatctttacgatctctccggttccttcatgtccaaggacaaccgggatcaggccgaatgggtctctcttgaattcatgggcgtcagtaccgcatacgccgcatccttcaacctttacaagaatatctccgtctcccagctcaggaatcgggaattctttgatatcatagtgttccaatgctgtcaacatagccacacgagcagtttttggaactgcctggtttcctgctgttgtatttgctgcaggagcagccttttcgcccagcatactttccagtacctgtttaacgactgcttctacatttgcggaattcatttccattttatttcctcctgtcttaacgaatgcataaactgtctgacatgacgcagcgtcttctctttgtgaaactgctcgcgcttgtaaggccttcgcctgtcctgctggcgattgtgaatgtacagaaaccctcgcccccgaacccgattgccgcatatgacgggccgttctttacaagaatcgcagtgtcaatggcttttgcatacttcgtgatgttgtctacgttcttggaatgtatgtgtgcggaatgtctgttgccgtgttccagccatacagcctgttcaaccgcatcatcaaaatcttttgccctgactacgccgaggatcggcatcattagttctgttgcaatcaacggatgctccttcggtccctcaaatgtgatacacctgatgttatccggaacactcacaccgatcattcccagaagcgtcttcgcatctctgcccacgcactttctgttcagtctgccgtctttcaggacaactgccgtcagggcatcctgctcttccttagaagccaggtaacatccctgctcgcttaccaaatagtgcattaattcgtctgtgacagagtccacagctacgatttccttctcagcgatacatggcaggttattgtcgaatgtacatccgtttacaatatcttctgctgctttccggatatctgctgtctcgtctacaagtgccggcgggttgcctgcccctgctccgattcccctcttgcccgaggaaaggacggctgttacaactcccggtccgcctgttgctgcgatcagatgaatatctttgtgtttcatcatgatgctgcttgattccagtgtcggcttctctaccgtgcatgcgatgttgtccggaccgcccgcctcaagagaagcttcattaatcatgttgatcgcatagattgatgtcttgatcgctcccggatgaggattaaacacaactgtattgccgccggccagcatgccgattgtattacaaagtacggtctcactggggttggtacacggagtaatcgcaccgatcacaccaaacggccccatttctatcagtgtcaggcctctgtcccctgaccatgcagttgttgtgatgtcttccgttcccggcgtcttctccgcaactaactgatgttttaaaatcttatgcccgacatttcccatgcctgtctcctgtacgcccatgcgtgcaagtatctcggcattctcaactgtcttctttctgatgttggatatgattttttctctttgatccatggacattctgcccacgatcttctgcgcttttttcgcagcttctattgcttcattcatatcagcaaatacgccgtggtttcctgatacttcggaagcaatctgcatctttgccatgacttctgaaacgatgtcctggatcatctgttcatttacagacacgctaatacctcctcgaaaacttctctgccataagcggctattgcggtatcttcctcagcggtaccgccgctcacacccaaggccccgattatttttccatctgcttcaagcggctccccgccgccaaatataacgattttcccttcattcgtgaattggattccgtacaaaggctgtcccggctggcttagatggctaagcgcctctgtggacatcttgaggctcgctgaagtaaatgttttattgatcgcaatatcaaagcttgctatgtaggccccatccatactctgaaccgcaacaggcctgcccgcctggtctgacacggcggccaccacattgacgcccatgctggcagcctttgcagtcactttttcgatcagtgcattggcagccttcaatgtcatcttatgcttgtggcacctgcatacatgtcctttttcgtgatgagaaccactttccttcatctggcccagtaccgcttttacggcattggtaatatcctgttcgttcatagcagtctcctaatataatttgattctgcccgcgggacgttctttttggaacctcctttgggtaagctttcttacagtcccagctgatccatcactttctttgtgatagatgcaactaaatcagcatctgcagtggaagcttccggtgcagcagcactgcatgatcctccgcagctgtggcagcttggcttgcctgcttttgcgttcgggcatacgtttgcaggatgttttcctggaagtcccatttttcttctgatttcatacagcttgtccatctgctctttgttgaactcctgtggctcgccaagcatctttgactgatacagaagctgtgcgtagaattccagggattccatcttgtggtatgcgctcagaaggctgtctgagtatgcaagcgctccgtggttctcaagcagaactgcatcgaaatactgtaagtgctcagaaacagcgtccggaatctccattgtagaaggtgtgccgtattttgcgatcggtacgcatcccagagcgataacagcttccggcatgatcggctgtgtcagcggaataccgcagatagcaaatgttgtcgcgtacagagggtgagcatgtactacggagtttacgtccggtctttctttatatacacgcatatgcatctttatctcagaagaaggtctgaatcctttgtttgcctgcagtacattaccttcagcgtctactttgcagatatattccggtgtcatgaatcctttgctgacacctgttggtgtacataagaattcattgtcattcaatttaacagagaagtttccatcatttgcagcaaccatcccgcggttgtacactcttttaccgatttcacacatttcttttttgatttcgtattcgttttgcatcctttttttcctccttggattcttaaaacaaaactaaacatttgttttttgttgtttctaactcgatattaccacacaatcccacagtagtcaacttattattgtgttggatttgttgttttctctatcctttttcagcctcttccagctcccacggaagcacatccccttcttcttttaagtactccagaatttccggaattccctcataatttttcgagtcaacgaagaagattttcttgcagcctgtcagcctgagccacctctcggcgcgctctacatttgcattcttatcatggatctttgtcacaatgccgatgacttcccggttgcacatagccgtacagcatggcggataaagggaatacggctccgttgccgatatcaggagcccaacaacatccgcctcataggagtataacgcaagggcgtatcccaaatgcttggtctgggcgtattcccccggagtgtctatgataacatcgaagttattcacatactgtgttttgtgatactggattttttcaccttttaatgcctgggtcaatgtggttttcccacattcgctcctgcccatcaatacgattttcttcatatttattaagtccttgttatctcacatacagagaagcccattttatccctcacataatccagaactgcgcggatcgcggcctctgtctctgaaatcgtaccggttacaatcaaagtaccgctgaaacggtctacgaatcccagctcgatccccgccgctttaattgcaatatctgccgcaataatagcggtttctgcgggactgattgtaagtacaccaattgctgacttactgtattccacccttgggtccaatcccagcttttcatacaatgtgatatccggacttgcaatcaagtgggcgattgttatttccttaccgggaactagttcctgtacgattctttccggcatttgttcataactcatgtttcctagcctcctatctgacattcaattccggatgccagttctgcagttttgagcagcatttccatcgtttcgtttgacggcggctctatattccccatcaggtattctcttcccagcccttcgtacttgtcctgacctagtctgtggtagggaagcaggtgaagcctttttacgctgcccagtctttttgtatactctgcgatatcccggatctcttcttgtgtatcgttaaaccctggaatgactggtacccggatgctcagctccgtcatgcctgactttgcaatcttcatcgcattttccagcatcagttcattggagcgcccggtgaatgctttatgctttgccggattcatatgtttgatatccagcaggtactgatccagatacgggagcaggccctcgattactttgtaatcggcgcatcccatgctttccatcgccgtgctgattccggcttcagatgccgccctcaaaagcgcagcggcaaattcgggctgacacaggctctcgcctcccgacagcgtcaggccgcctccggtcctgcggtaataggtacggtctttttcaaccgtctccatcacttcttttacagtgacgtcctctccgattacctttggctccccctgtaccatcatggtctcgatctcaaactgctgcgattccggattacagcaccaccggcatctcagaacacagcccttcaaaaatacaatcgtccgtattccgttgccatcgtggatagaatatctctgtatatcgaaaatgcggcctttcgtatttaaataatcttccatgctgcgattcctctcttccatcagaagccctgttccgttctccggatgatatcatcctgaagcgatttggaaagcgtggtgaacaaagcgctgtatccggctacccggacaaccagatgcttgtactgctccgggttcttttgtgcatccagcagtgtttcacggctgactacattaaactgcatatggcttcccttctgatcaaagtaggaacggatcaggcctacgaagttctcaagccctcttctgccgctcaatgcggatgggtggaacttctggttaaacagtgtcccgttggatgcaatatagtgatccagcctggagacagaattcgctgccgcagtcgggccgtttatgtctttccctgcggacggtgaaacgccgtcggcaaccggtgtatgtgcaagacgcccatccggtgtggcgcctgtctgtgcccccagcggaacattggcagataccgggtataagcctgcctggaatataccgcctcttggattcttataattctgcagaggcttcgtatatgtataggccacatctcttgcaaaagcatccacttccggaatatcattaccgaacttcggaacttcctcgatcaatttgaggatacgttctccgtttgcttttacttccggagcctctgaagcggctactaccgttttcagaattgctgcaacctcgcgctcagtgacagcctgtccggccgctttcataccgcctgcaatctctgcagtcatggacgcaacatcctcaccgcttaagcctttgccgtagtttgtagccagagcctctttgagttccttcatcgtaactttcttttcctcgtaaaccagctttttcactgcaaacagggaatctgccatgttcgcgactccgaatccctgagggccggtaaagttgtagactgctccgccttcctgcaccgtcttccctttcttcatacaatcatcgaccatagaagaaaggaacggaagcgggcatctctctgcatgggcaacgtcaatggcattgtccgcattcaccaaaagtttgatcgcgtaatccatctgaatcttatatgcatggtagaattccccgaaggtcttcatatcttctacccgtccagtctgcggtcctacctgcacccctttatccttgccgttgttaaaaaccagctccagcggacggcacatattaaagaatgccgcatcatgccagccctctgtcttacctgccttctgaggttcaacacagccgataatattgtaatcccttgcatcctccagcgtcagtcctctgctcaccagggagggaataatcacttcgtcattgtaatacgccggaagtccgatacctgtacgggtcagttccgccgctttaataaggaattcatgaggtgaaccgttccatactctcacggacagggaaggctgcggaaggtaaacatgcatggatgcctcaatgctcataaaagataaatcattcgttacatcaatcccttcctcattctgacctcctgcgatcagattctggaaaaggctgtatcctgcaaatccctctgctgaaacagcatcacggcacttattcaggtcatttaacttcacccagatgcagtccatcagttcctgcgcaaattctcttgttatctttccactgtccaaatccttcttataataaggatacatatactggtcaaatcttcccggagagattgagtgtccgctggattctatctgaagcagctgctgtacaaaccagaatgactggcatgcttcataaaatcccgatgcccctttttccggaacatttgcacaattttgggcaatctgaagcagctcttttttgcgtatcatatccgaacacttttccgcctcttccagagccagctttgcatagcgtctggcataggtaacgacagcatcacagctgatcatcacagcttccagaaatctcgacttctgctgataatcaccatcggccaggcacagctttgccatctcggcttccgctttagcctttataccggagaatccaatttccaggacttctccatacttcaccgtaacatggcctacgccattataaaaataattgcccggtgtgaaaatgttatgttccatagcaagcagtgtctcaggctccatataggaggtagccagctcacttgttgtctttcccttccagtatgcattggcctgcttcagctccgccttggtctgatctgatatatagaacggatctgcacttctgttctccacggtttcaaattcctcttccagccactcatacgaaaattccggataagtctgacagcctcttggcgcaagcgttgtgctgcctacaatcagctccaggtcccggatgataatcggaatgttttccaaaatatgctgaaatgcctttgcacggcggataatcaccggctcgctctctgtctgcttatatgattccgtcaaaagaacagctcgagctgattctatctccggcatcttggcatacaggttctccacaagctttggaatacgatccgactttggtatgtccgtactgtcataggtatataatcccatttactttgttactcctttccttatgtataaatacagcctgcatctatacatagaatattaaccttcagaagataaatcagagtttagcctgcggcggtggcaccgcagcatctgcttacactgcaatatgcatcccccgccgggttttaatgaatctccacccagtcttaattattatacttgaacactgctcagaagtcaacacgaagcaacatgatttaaacgatttttatatgtgaatccaactaatcccaatacttattttgttgtttttgttggtattttcattttttattttagttttttattgacaaaccaaagagcatcgcgcatactataaattagggtatttataatgaaagtgttcatttcgttactatgcatggtttatgggccgtgaatcgtaacttcatttattactgatagaaaggcctaaaagatatgtcttctttccaatttgatatacatacacacacaatagcaagcggacatgcctctactgcaaccatcacagacatggcaaaagccgctgcttccaggaatctgaaaatgctcggaatatccgaccacggccctgccacctgcggcggcggaaagccctcttattttcgcagcctgtcctatgcccaaaaggagcgtcttggagttgagatgctttatggtgcggaagcaaatattttaaataatgaaggaaagctggatctggaggattccatacttgcaaaactggattatgtaatcgccagcatacacaagccggtcaaaaaacccggcaccatggaggagaatacagccgcatacattgcagccatgaaaaatccctatgtccgtattatcgggcactgtgatgatgtaaagtatccggttgattatctggaaattgtaaagacggccatgaaatatgatgttcttctggagataaacaacagttccttaagccctgacggctaccggggagatacccgttttaacgacttgatgatcttaaatctatgcaggcattatcattacccggttatattcgcaagtgacagccacggcacaaagcatgtcggagactttactttttcgctggaactggcgcagcttgccgggatgccggattctctgatcatgaattattctctgaaggccttcaaatgttttctggagaggtcccgtcaggatgtctgatgaattatgtgatcggctgagtgttccatcttgaactctttatggaacattcagccggtcacatcagttatctggcatactaaagcttcaggcggtatgacaggattcttatgccggccttccccacccttttgcaaaaccctccgggcagctgctcatcccagtttatgatgagctcatcgaggggcatgtgcagcatctggcttaacgtgtagaagttgtccagagatggcagtgttctccctccaaaccagccatagaccgactggggacatgccaggccaaggcattcgcagatctttttcacgggtatgctatgaatcttgcagacaaaacgcagccaccttcctgttcttgccatctgaatcccggggtaacggcttatcttggatagatcttctttttttcgtcccccctccgccggaccgcctcccgctttgttctgtttttctttcatccgtcctcacatcctttttcatttatcagggctgcagcatgtttctcaattccctgtccatggtgaatcatatcctgtaagcaggcagtgaaaaacatgtcccttagctctgcccttccttcccgttccatcataacacaggcggcacaaatttagctactgcttagtatgtcaagcagtttgtaactgcatgactctgtctgcctttgcatgtaaaatagatctatatcaaatgtaaaggaggcgctctatgagtaattttaaagacctttccccggacagccagccaaatgataattctatgaagcctgtattaaatggcgcaaagtcggaaagctgtttacctgactggattgcccggaaacaggggcagtgctcccgccaggattatgaattgctgccttcttctcttcatgcccagctaatgaacggatatattctaacccgtcctcctgtttcatttttgcatcaggctgtcatcacggaattactctgccaaattgtagcatatggcaaagaatcttattctccctgcaaagctgttacctttcccgttcgtttttacctcaatgggggaaatactatactgattcccgatattgccataattctgcatcccggcagaatcattggatataagatcacagaagttcctgttttcgctgcggaagtagtttcacctgacagcaaagatctggactgttctgtaaaggttcatttgtacagggagctgggagtccgcgagtactggattattgacggacagaaacagacggtaaccgcctgcctgtatcattcgaaggaaaaggatgaaatggaggaatacagcttttctgacagaatacgtgtgcatacggtagaagggctttatctggattttaagcagcttagggaatagatcagccggacagtcccgaataaccacaccaaaaatagtatacttacccaggcagccgggagggcggatccatccgtttcggagtttaacgaaaggggtggtgcttatgtatgttacatacgataacttatttacatttgtattgaggattattgctatcattaccttgtgaaaagtttatatgataaacgaaaaaagtaatcgccccgtcttggcaggataggcgattactctttgcagtaacatcttacccggtacggataggcttcatctatcaatcccggctgtcttgttaagtatattataacaaatttgtcttgaatgtcaattttagattttcttcttatatctaacctctgtccacgttttactaaagatcatctaaggttaagctcttttagaaagtacttctgcctcatagttctgtacttctttaaaccagtcttctctttccggaacattgttgatttcgcagaaataattccatacatcgccaaacggatagcatttcagttcttcctgcattgccatcagctctgtaaactgctgtgtatcctgcagttctttcagccgtgcattcgggcttaacatcgcgcacatcagagccttctgcatatttctcatgcccactacccatgcggagattctgttaatacttgcgtcaaagaagtcaaggccgatgatcactctgttcagagcatcatttcttacaatctcttttgcaatctcttttgtctcatcatccagcagtactacatggtcactgtcccagcggattggtcttgttacatgaagggcaatcttatcattgaacagaagcatagatgaaatcttatcagaaacgacttctgtcggatgataatgtccattgtccatcagaggcacaatccccttgttcattacataattcattgtaaactctgctgaacctgctgtgtaagcttccaggccaataccaaacactttagactccaggcataccagcactttttctttatcatagtcaatgcccagaatctgatccagagagtctttatatctcgctctcggtccaagcctgtcagccggaatatccttaaaaccatccggaatccagatgttcatcagacaaggggttcccagttcctcggcaaaatactgagagatgcggatgcaggcttttccatgctcgatccagaacttgcggatctcttcatccgggcttgtcaaagtatattcatcagccttcgggtgtgagaagtaggtcgggttgaagtccagtccaagacctctttccttggcaaactccacccatttagcaaaatgctttggctccagcttatcacggtctacccattcaccctcttcaaaaatagcataacttgcatgaacattgattctgtgtgttcccggtatcagggtcagagccttgtcgatatctgccatcagctcttccggagttcttgccttaccaggataattgcctgtagcctggataccgcctgtaagtgcgccctcactgtcaaacccgccaacatcatccccctgccagcagtgcatagaaatcggaactgactttaatgtctccagaaccttatcagtatccacaccaattttcccatagatctctttcgctgattcatatctttccttcgttgtcatcgtaaatcctccttcatttttcaaaggggtctgacccctttgcgtctcattgtcagaattgttttccattttcatcgtacttctttatatcaaatgaccgatcgatacatgtccgcgcctccggaaggcttgcaaacacgccatcatgcatcatctgaacggttacattgccgattgcagttgcctcggtggggcctgccgaaactttctttccggtatattttgcagtcaattcatttaaatatccggcattggcacctccgcccactacgtaaatcgtgtcgtatgtattgcctgtgattgcttcgatctctttcacggtatcgccatagcattttgcaaggctgttgtatatgactgctgcaatctctccgatcgtgagcggaacctgctggcctgttctgctgcagaaatcctgcactgccttaatcatgctctcaggtgccaggaaacagtcgtcattgcagtctactatggatggaatcgtttctttggatgccctgtcgcagatttctgcaaaggacagatcctccgcaaactctttttttactgactggatcatccataatcccataatgttctttagaaagcggaatctgtggtcatatccgccttcgtttgtaaagttggcttgcatgctttccatcgaacagtctgcttcttttctttcgatgcccatcagtgaccaggtaccggagcttatatagattgcattatcatcgtttgtcggcactgccagtaccgctgagccggtgtcatgagtggcaggaagtacgactttacagtcaaagccaacttcatcttggatttcttttgtaaaattgccaaccacagtgcccggcatagatactggatggaacatttttgaatgatatcccagcatatcgatcatctcgtaatcccagtcgtttgttgtaggattaatcagctgccccgttgtagcattggtgtattcgttcttcttaacaccggtcagcaggaaatggaaataatccggaatcataagtatcgcctccgcctgctccagatgttccggatggctctccttcaccgccatcagctggtaaatggtattgaagacctgcttttggattcctgttcttgcatacaattcttccggggagatcttctcatataccttcttgtctatcccactggtacggctgtcacggtatccaacggtatctcccagaatctgatcttctttatcaagcagcacataatcaacgccccaggtatcaatccccatcgaaaccgggatctttccgatctctttacattttttcagcccgtttttgatctcattgaataaacgctctacatcccagcacaaggtaccgtccttattatccatgccattcggaaagcggtacacttcctcgagccgcatcctgccttcggccatatatgcaagcatatggcgtccgctggatgccccgatatcaacggccaaataacatttctccatgttgtgcctccttatattttcttcatactttttcaattgtaagtctattataattggtaaaagggtacaaaaaaaggacgctatttatttatcacagcgtccttatttgcatcttaatctgcacactttaagaaaagcactttcagaagattcgtttcttccgctggtgctttttatctttatcgtactttttttatgcagtagtttttcataaattctataatctcagcatcatcatccttttcataaaatttaattaacagcgttttaaactattctaatttttggttatcataacataccgccgaacacctttgcaaaaatctcatcctgttcctgaagatgagtcacatatccgaccggaatcttattctctgtagcatcaataattgatttagctcccgcttctccaaaagcaccgcagagttcaatgcagtctatcccttcttcatatagcttttttgctacttcgcatgcttcttccagacttgatacgccgattgtctgcacccctccatcgtgtatactggcacaatctctctgtgaatcaaaattctctcccataattataaatacaaatctcataagaatcctcctcatattactggctttattaattttttttaactaattataccatactatggaaaggaaatatatgaatagaggcaagttggttactattcacggggccgtgcaccacgctgcacggcatccgagccaataaagtgatggggtcgggcatctggctcttcgccacgggcgactttaaatgagccagatgccgttactatgcacggtctatagaccgtacatatcaatgcttatttcccatgccctctataccgggcagtattgaaaccgctcaaaccaagcgtctgttttttcagcaaacacccccacatagcatccggtgaaagtcatgggcatacactctgttgataaaagctgtgtcctcccgctgcctgccatttgcagatgattctcatctcttcctgcaagaaaacgatactccagtgcatcagactcaatcctcagaagcattttctccgaaacgtccaaaaataagggctggctctccgtctgcatatcgcccacccttttatacagaattacacaccgtttcccctctctgcatgagacggcaaggtcatagtggtgctcattcgtatgataaacggttaatcctgcacgcgcttgcggtccctgcggtgcggcatccagccatacctcagcccgcatacagaaatgctgctgcctccgccccacaaatgcaggcgaacacagttcatctaatgtctcatccccaccggccagcttaaggcttcccttcctgtcagtgagactgtactggcgcagatccgggtttctcaaataattccacaccttaggcaagacagaaccataaaaggaatccggatcctcccatctgatctcataagcctcttccggaagccgcatgacctccatgttttccagaatcttttccccctggttcaccacaggccatccgttttcgtcccacgtaactggggcaagcatggtttccctgcccagatgatggagcatgtactggcttgtccgtatcccatggaataccatccaggagtccccttcttttgtgtcggttacatccccgtgcccaatcgcctgaaaatgatgcagcatcgtatcacggtggctcagtatcgggttatacggacagctttcaaatggtccccatggagaggttcctcttgcaatcgtgaccatgtggccgtactccgttcccccttccgctgccagcaggtagtaccatccctcccgtttaaacatgtggggaccctcgggatatttgcctccgctcccttcccagatgatctttgtgtcggaaagcctctttccgctatcgatatcaatctggcactgcccaatcgcctggctgtccggcaggtcataggtgcttgttaaatatacgcagtagtcagagtcaaaaaacagggaagggtcgatcccgccctgttccatccagattgggtccgaccactccccataaatatcgtctgtccagacgaaaaaatttccaccatggctgaagttcgtggctgacacatagaatctgcctttatggtgacgtattgcaggcgcccatattccaccggaagccggacacttttccagcaatgcctgggattttctggtcagaacatgcccaatctgttcccagtgaaccagatcccggctgtggaacagagggatcccaggaaagtattcaaaagaactggtcaccaggaagtaatcttctttcacccggcaaatgctcgggtcagggtaaaaccccggtatgatcggattttgataatgtatcattggcttcctcctttacacgcgcacccacaccagcatttcgcccgtctctctgttcccccagaggaaataggggaccgcttttacggccacttctttctccctccggatatatggacggtaaagctccgcggcccatccgtcttcctctgtacgatatccttttgccgtaattgctggtatgccgccggacagtacagtttccgcaatctgcagtccgcagtccgtatctaaccgaattgcagaaagattgcttccgttgtcttcctcttccagacagtacacaaccggccctctttgaattgcagccttcccggcatctgccctgacctttggatttgcctgaatcagctctgcggccataacgaacagcagacgaatctcatctcccgcccggatgccattttcaagatatacatatcccttttccacccggcattctgccgcttttccattctgccgtacttcatactcatggcaccatcccggaatccgcagcgcaatcctgctgtccgtatccggcactgaacgcaccgtaagccggatgtctccgtcccacggataattgccgttctgccttacacaaaagtcaccgcggcctgtttttatccttacttccccggctatatagagatggacgtacagcgtatgttccccataggcatacacgtattttcccagagaagaaagcagtcttgcgatattaggcggacagcaggcacagccaaaccatttctggcgtttcgcttttacatgactccggtccggatttttttcgttagccagaggccagacttcctgcggattcacataaaagaaatgttttccgtcacgcgacatggagctaagaaccacattatataatgccttttccaagacatccccatatatcccgtctgcctctatcatctgcatccgatgcgcaaaaaaaatcagtccgatggaggcgcatgtctccgcatatgcagtctcattgggcaggtcataatccacggtgaaagcctctcctgtcctcgtggaacctatagccccggtaatatacatctgccgttccaccacattttcccagagccgcctgcatgacagatacatttctctgcttcccgccgcccttgccacatctgccattgctgcgtacatatacattgccctgaccgcatggccggctgccgaagtctggtcatacacaggcaaatgtgactgattataaaccaggtcaggactctccgccggcaggtctgtcttaaaggaacattgttggcgtaaagtctcccattcccatacaaaataattcggttccctgccccgctcctccaaaaaataacggctcagctccagatactccctgttacccgttgcttcatacagtttgaccagcgcaagttctatctcctgatggcccggataccccttctgtcctcctttcctgaaatgttccgcaatatgatccgcacatctgcacatcacgtccagcagctttctctttcctgtcgctctgaaataggcagccgccgcctccatcatatgtcctgcgcaatacatctcatggcattcatacagattggtccattccttctcctgattccctatcgaaaaataggtatccagatacccattctcctgctgggccgcggctataagatcaattacctcatccatgacggcttccagctcaggctccggagcgctctccagacagtatgacgcagcctccagccattttgccaggtcgctgtcttggaacacctccccataaaaacaacctttctccacgcctgctgcaattttaaaattccgaaccgcatggcttcgctcaacgtccggcacccggtcattcagaatctcccactgatagggaatcaccgtatcccttaccaattccatatactgtgaccagaaagtatcctgaatctgtacctcttttatttctgccggtctgcatatttccagccgttccatattccgcctccttcttcatacattattttgcagcttgctgcaaccccaccccgcaagggcatgtattacgggacgccctttgggtatacattattttgcagcttgctgcaaacccgccccgcagggtataattccggtgtgcccttggatatagaatttgatcccggaaccacatggctccgggacactcttttccttaagctttaaattcctcgagaaccccatgtttcaatgccccggtgaacctgactcagaataaatattctaaatgaaccactgtattctttttgaattctatatcagctccgtttccgtctttatcataaagcttcccgttcacccgcaactccttgtagcccaccgggaaggagacataaatcacctggtcttccatactaaatatttcaacctccgcttttccggcctccatatcccagctcatcttctcaatcttagcaaatgtataaagccacattccttccagatttcctttgcttaaatcccccggaactgcaggcagcagctttataaagccttcatcggaataaaccagcatttccagaacaattgccggcatagctcccagcaggtccggacagaatacccggtatggataatgcacggtgttcagtgtacgtgttacgtagccgtgctccatcagagtacgaaggttatgcatggcatccggcagatcgcccagccttaccgctgtaaaataccgatggatgacgccatgggcagaatcatcctgatgcccgcgtttccggttggaaagaataaacggctttacaagctccggcgttttctccggtgaaacagcccgccccggccagatatcataatggtgggaaacgtgccggtgatcatagttttcccctgaatacttgaaggaccactccttaatcgccccgtcctcatccatcagatagtccggcagtctgcccctgagcgctttccatttcggaagatccggttcgtccaggccaagaacctcacatgcctccatcaggttatccagtacctctctgcataccatcacatccatcagtgaattcacattcattgcatagacatccttcgggaatggcacgtgataatcattcatggaaggatcttccggcgaataactcggatagaacattacctttccattttcatccacatcagtgagatagtcttcataaaataatgcgatttccttcaggcccgggacaatacgttcacgcaggaattctttgtctcctgtcaccagatagtgcccccagaactcgttataaatccatcccagacatgcggtccagcagtaatgtggatatacaatcgaaaactgatagaactttcctgagttataatcacagtgaatatttccgagtacgcccctcgctccgtaaaaacgctctgcattcagacggaagtcatcgaatttgtcctcatagaatttgaaataggtatccatgatttcaggcagccccgtcatgttcccggagcagacctgcaggttggtattaatattatgctggaacaaggacggcggatcatctccggtgtccgttatcataaagaaacgtcccatatcatacagcttttccagcatcatagcacttaactcgcccccgccgtgctgttcgttgagcaattcctctgccgccatagcccagtcccccttaagccgtatcacggagcgttccatcaaaggctccaaatatgcccggtttgctgccagcatatcttcgtaggaatcctggatttggttcacttcctccagcaccttttcagccagagcatggcggtatgcttcttcatattttacagttcgggaaataatggtgatctcctttgcgccctccacctgcagataaccgccctcacggcaggatacctttccatccgtgcggatcacagaacagcagcagtacccacgttcaccgaactgcgggtcatatgccaatgatactgtacagctttcgggcgttgtcttgatttccacatcgctgccttctatctgatacatatcgttataggtgacaagcacaaactggtcgaaatggtcaggaagatcgtacccgcccggtgcaacaaagcgtatgttcatatcaaactgctctttattcaggcgctctgttttttgcacaactgcctctttatcaaaggagacaaaagacctgcggagaatgcctcctttttcatcctgtatgcgcaccactgcttctcccgacatcatatcaagataccgcaggtaatcgcagcgctcctttccttcttcgatttcggtcagcagctcaataaccgaatggagacgcggatgcaggcgcggaaattcaacgccaaaggggcggctgtctatccactgatcataccccgccgctttcgttgcttcgtccatcacccttgcagcctcttcaaatttcccctgtttcagaaaacttctcgcttccgggatcgcataagccacatccggcggttcgggcgtgtccttccagcgcatatccatgatcctttcacggcggtagattacgcgctcatgataaggatcccccacaatatcaattctctgcctcccgtttgcagtcaccagaacatcttcatccgccttagccggatacaggctgctcacacttttataagggagaagctctcgtcttttttcaattcccatgggtggatatttcagggcaaattccactgctttcataccataactgctcataaaatcctccttatcctctcttcatatgattcagaatttcctctcgtgcctgccggcgtctgatgccggacggagcacttgtatgagcagattatacgtcccgcagggctgatggtaaatggaatatcatggactgagggagggaatattttgaacgtataggcacactgcggtaaggcgcgcttctgcggacggcctccggctttatcttcccccgcccgtttcatccgcaatatctttctgcatttgcgacttatacacaattggactgactccatactgctgtttaaacactttgctgaagtaatactggtcactgaaccccagcaactctgcaatatccttcacccgtatgttctcgtattcctccagcatctgttttgcttcattgattttgagcctgttataataactgataggagtatcgctgtaatatactttaaacagcctgcagatataggacggcgaaatatcaaaataatccgctatttcctgcagagataagttcttatacagattcgcctgcatgtattcggtcaatttatacgcagcttccatcgacaccccgcttttttcctcttttgaggccgacataaattcgctgtacccctgcagacattcttccagctccccgtaccttctgcagtcattcagtatctgatccgccagcgtacccggctcatccgccagttccccgttcccgcctgctgccgcaaacatttcgtccagcagcgccaggaggaatttccgcagtaccgcgacggtataatgcttttcttcccaggatagaatattcttatgaatttctttgcgataatcatctgcagccttatttttcagaatccattctattttcctgcggaatacttcaatctcctctttctgccggatataccgctctctcacctctatatatttctcatcctcaaagactttgctgcattccagcatcaccatcctccccagccggttagaaagatgggtatactgcatatggagctgagtgatatccgttaggcagcccgaacagataatattgacacgtgtatacttcttccgcagttccgacaagagtaacgtatttaacagcatgatcctcttttgggaactgctttccagattaaacatcacgattttttcactgttcagcctggtatttgctgtccgaacatccggccccgccttattctctgccataatttctttgaccaattcctttgacaagggcgccgcatactgctgaaaaagccctacccgtaccaaagagagcatgtaacgtcccgggaatccgttctcctctgttccaatgccttcctgaatcatcttttgcagggcagattcttcctcctgtacctttttgctgtccgccttcatggtcagcttctttaaaatctcagcaaactcccctgcatccacaggcttcatgatatagtcatctacctgcagcatcagagcctcgtgggtaaaggtaaagtctgcatatccactgataataacgcttttcacccccggataaagcgccttggccttctggatgagtgtcagcccgtctatgaccggcattttgatatccgtaaagatgatatccggctcaaagtctttcaaaagctcggcggcagcttctccgtcatatgccgttttaataacggaatcatagcctgcttcattaataagatggacaatgtctcttaagatgactttgctgtcctctgcaacaagaaacttatacatgtttcatccctcccccagtgcaaaggggtcagaccccttttgtagtgtttgcgtttttataacttatttgacactattcattctcaaatatgaacctgccgcccagacagactgccgcgccatcttccggagaattattctttatactgaattcaaaatctcctgcaaagtagattctcagccgaaggagtgtgttcagaatccccaatcctcccatgcctggttccccctcagagctgtcttgcaaattgatgaccagactttcttctttcatcctgttttcgatctcttttattttatcctttgaaaatcctctcccattgtctctgacctcaactttccatttcccgtccctggcgattgccgtcacacagatatgatagggcggtttttgtccctcaaaagcatgctgtatggcgttttctacaaatggaaggatacaaagcctggggatcaggatagaacgtgcctcctcctgcacctcaatctgatattgcagaaaatcttcatagtactgcttctgaagtgcaagatagtttgtaatgtattgcatctcctccccaagagttaccgtatgcgcattggagttcaccgtatagcgcagcatgtccgaaagctgtttgcacatggcctgtgcgtcctccgtgcggccttctcttgcagagatgctgatcgaatacagaacattatggataaaatgtggggaaatctgcgcctgcagggcagaaatcctcgcccctgcctccgccttattggactcaatttctctgaaagccgctaattttagatcatccagtatcttctggaacgcatctttaagctcgataatttcattattagagacatcctccagattcagacccatattctcataggtaaccttcaatacgctgttgcgcagttcctggaggggttttaccagcatccgcgaaaatacaactaccatcaaaattgcagcagccgtcacgcatataaaaaagatgatcgtagtatgctgcagtaatttcattgaggaatatattgtatcttttggatactgtatataagtcgtgatccccgaataatctgatgaggcataaaagtacatatggttctccacgctaaagacaccgcttttattcttttccgccagatttcttttgaataaaccgctctcttcttcagaaacggaactggacggatatacggtatcgcctttatcattcaaaagaaggacattgcctatatggttaatgttgcagatttcatccagcttcttataatctgactgcacctcaatataaccatatctgttggcgcttacatcaaagaccgcacggataaatgatatcgttgcaccctgttcatcctgtgagccgctgtcatgatccgcatagataacaagctccttcttacctagcttttccccattgtcctccattgtaagggcggatttaaaattgcttttgtgctggttgtatacataagaataagaaccatcctgactgtaaagatatacattgacatgaggaaaagacgtcagcgtaatcgcattagagacaatggctgcgatttctctgttccgctttaattcctcatagtccgacaatgctttgggattgtttttcacctcccgcatgatctgcagaagacccggatttgagatcagcttttttgtgatatcatccattttttcgatataggtgtcgacattttcggatatttttatgcatagctgcatatcattataggctgactcctcttccatctgtctaaagatgtgcatacggataaacaggctgaaagatgccgctgcaaataaaataataatagaaaaaacgacatatagtttagtcctgaacttaaaattcatatgggttccgctcctcctgatctgcatggctgttcctcctttattatcccaaataacagtaaaaagtcaaaccgttgtaacagttcagacaggactgcactgttacaacccgttactatgctcggcctataggccgagcatagtaacgtcaaacctcatccttttaccgcgccttctgtcaggccgctgataaattgcttctgcataaacaaaaacagcaggatcaccggcagcgccgccagcgtcaggtctgcaaacaccagattccagttactgcctccatacattccgaaaaactggtacacagaaaggggcagcgtcctctttgccgggtcgtttaagaagtaaagcggtatattaatttcattccatattcctgtgaacagaagaatcagtacggtgatattacatgatttcaggagcggaaggatgatgtagaaatacgtctgcaatgtggatgccccctcgataaatgcggattcatccaacacccctggaatcccccgtataaatccggtataaagaaaacagctgaagggtatgttgatcgccgtgtataaaatgataacattcagataaccgccatagatatccagaaccgtaaataaacgaatcgtaggcataatctgcatcgggataatcgtgccgataaagaaaaaataatacaggaatctcgagaacctggtctttcgccgggcaaggataaaggatgccagagaacttgtgaatatcgtgatcacggtggaggctatggtaatcagaatactgttcttaaatgccagcaataattttccctgttcaaagacagttttaaaattatccaccagccattgctccggaagtgtcagatcaaacgccgtcacttctgccgaattcttaaaagcccccagcagcataatcagaagcggaatcacaataaccaaagagatcagaatcagcacgatctgcagaagtacctttgttactttctctttttttctgccatacattattcctccacctccctcttcctcatcttatacaataccggaatgcagataatagaaacgaaaaccgccagcgtaacgttcagtgcggtgccgagcccccattgacctcttccaaacttagagaacacttccagtgcaattacctgagacgcatttccgggacccccgttcgtaagtgcatatggttcactgaacaccttcagcccgccaatcaagcttaacagcatattaatattaaatgcaggggccagcatcggaaacgtaatattcgtaaaacgctgcagggcgctggccccgtcaatcttcgccgcctcataataagatgccggtacagcctgcaggccggcgagataaacaaccatatgatacccgctccattgccagattgatacccccgctatggataccattacgatcctggtatctaccagccatttctgctgcagggcctgaaggcccacatgccccagaaattcattcaggattccgttaggatgtaaaatgggcacaaacacaagcccgatgatgatcgtagaaatcacgcatggcagaaagaaaattacccggaaataccctcgcagttttgtctttgtatttaccgccagcgccagcagaagcccattgacatttttcccgatcaccacaataatggcgtatacgaaggtattatatatagcatgtttcaattcaccgctttgaaaaatcgtcttataattctcaagccccacaaagctgatggtatccttccctatcgtccagtctgtcaaggaataatatattccatagatgctgggtaccacaaaaaagattccaaatatcagcagtgccggcaggattagcagatatgtatataagtgtctggtccgtcgcattgtgatgcaccttgcctttctatcatgattatctcgaagaagattcaaaagaaaagcaccgcccagtctgacagaagcccgcctttcatacgctccttccggactgtccggtgcctaattttcgttatttctgtttagaagttttctattccttttgacttcatcagttcttcaaaagtagtatcccaggaagaaagtacctcctccggtgttttcgctcccgcaaacatatcctggaaatatacccagaggtcgtttaagtcaaccttcatataggcattcatttccaacaccgtcttacccgtcttattatattcttcgtataaacgcccctcaaactcatcgaattccggttccttagcgccttttacgttcggaacaaaagaggctgccttctgagcagtatcgcattgctcaggctgtgccatgaaattcagaaacttcctggcctcctcgatatgctttgcatctttcggaataaagaactccgcatccagctggctgatggtaagatattcgtcctccccctcatatacaggataggggaacatatcaaactgaatatccggataagcattcagtaaatctcttaccgtggtatttgagcccactgtcatggcataatcgccgctgctcattgccgccggtatgctgttgtaatcgtcggaaagtaccgtgctctgcatatatccgtctttatacagatcatatgccttctccaggctctccctgaatgcgggcacctcatcccagccaatctcgtttgcattcaaacggtcccacagatccggctctgattttgctgcataataaccccaggtagaagttgtccacatctggaatgtccacacatctttaaatggaccgtaaaacggagtgactccctgtgcttttaaattttcgcagactgccagaaattcctcatatgtcttcggaatttccacccctttctcctcaaacagatctttattatatacaacacccatgccgccggtcttcactgcaaatgcaaacccataaatcttcccgtccggtgccgtcaggatttctttgtctgcaaggttctccacaaacggctcgtctgataaatcaacacagtttttcgcaacttccagttcgttctctgcggaaactttgttgtagcaaattaaatccgacggctgtcctgaggccagctttgtctgaatgatcgacgtgttctgcgcatctgggttcagcaccagctctaccttgatctccggatattgttcctcaaaggccgctatattttcttcgctgaaagcatatgggatattatttacgatctcctggcttgcctccacggttagggtgacgctttctgccttcttattcccaccgctctcttttccctcatccgaagaattgccggccgaagaaccgcagcctgcggttaaaagggacactgccataagcattccggcagctttcattaactttctcttcatttctccttcctccttatcaataattctgttgtaacgatctacatgcaccttccgcggaactttcgtttgtgttaggtttattttaactttcggctttaaagaagtaaatggaattaaatgaacgacaggattaacaatattgaacaattaactaaaaatgtaaaaaaacgcaaaacaacgcagtttgcacttcatatttttgtttaaatcttatagaatacacctaatatcaggaaacagatagggcactttcaccagaagtaatttgtaatccttagatatatacgaatcaattgcatccgtattttaactctaaacagcataattacgcaaaaagaatagtaataaaattttcaagaaaggaggtgtgaaatgagtacagtatataacgcagaactcgtcggacaggtctttaacattcagagatattctacacatgacggccccggggttcgtacaaccgttttcttaaagggatgtcctcttcgctgttattggtgtcagaatccggagtcgcagagtctcaaaccagtgctgatgatcaaaaaggaccggtgcacgggctgtggtcgatgtgtgcaggcctgtccgcagaaagcaaactattttgcagatggtgctgtggcaacgaaccgctcactatgtactgtatgcggacgatgtgtcagcgcatgttttaacaatgtccgctcagtagaaggagagcccatgaccgtgaaacaggtcatccataaggtcaggagagattacaacttattttgtaattccggaggcggcatgacaatatcaggcggagcctgtgaaatgcagccggaatttacaattaatcttttaaaggccgctcatgatgaaggcattcgtactgccgtagaaatggaaggggcttttccctgggaaacggtacgggcgattgcagaacattgtgattttatcatgtatgatctaaaacatatggacaaggaaaaacatataatgggtacgaaagtatcaaacgaaagaatcctggataatgcgaaacgccttgtaaagatggggaaaaaactgcaattccgtacaccattgatacccggcttcaacgattctctggagtccgttgcagctattgctcatttcattaggaatgagcttggacttagcccggcagaataccatgaacttttaggatataacaatcttggcgaagacaaatatgaacgtcttgatatgccgggaatctgtccgaaaaacaaacgtcagtctgaggaatatctggccgaattaaatgcaatacgtgaatctatttaaacacgcgattccattctgtttctatttacctgaccgaaagggcccacggtcaggtaagaatatagatattaatgtttaatatgagaaaggtggaaataaaatgacaaaagttacctataagcaatatcatggaaaaactcgtggtgaaactatttgggaaagattaaatcctctgcgctatacacagacaatgtccatggcacgcgcccagcttcttgcagacgcttatgaagaatacgccggttattcattttatcgtaaacgtggatattccattgcaaaaatactgaaagaaatccctatttatattgatgatgagcagctgttagttggtgatttcagtgcgaaaccaatggggcctgagtggttcccggatctagctgcaacatgggtcagtgattatgccgataaatatggatggaagggaagcggaaagttcttcgcattcgaaagccctgaacaggcacaacaggcaaaagatatcgcccataagttccaaaatgtgggcggcaaagaaatgtggtacaagtatcttggtgaagaagaggtcgcttttgcagagagtgtcggtgaacagggcgcatgggtctgcaacttcctttcagaggtctatgctgaaaaggcatggcatgttccggatatttcaagaatcgtatcaaagggcgttagaggcctgattgcagatattgacgagcagcttgaaaaactcgtgatcttaacagatgaggattaccgtgcacacgagttctggcttgggcttaagttaatgctggaaggaggcattgaatatgcacatcgctatgcagcacttgcttctgaaaaagcggcagcggagaaagacccgatgcgtaaggctgagctcgaggaaattgcaagggtatgcatgcgggttccggagtatccggcagaaacattccaggaagctcttcagtcattctactttgggatcctgatgatcttctatgatacacgtacatatggaatggggtttggccgtgttgatcagttcttatttccctgctttaaatcagatattgaaacaggctacatcgatgaagaatatgccacacagcttctcgagtgcttccgctgcaaggtcatgggcaagcgtcagttctggccggatctcatgactccaaacttaagttcagagtcacatttccataattgtatccttggtggtgttgatccaatcacaggacgggacgcaacaaaccgtttatcttatctgtggcttgatgctgctgagcgcgtccatacaccgcatccaaccctttccgtccgctaccatgcaaacattgacagaaaattcatggaacgtgcgctggaaattgtggcacttggcatgggcttccctgcatttatgggtgatgataacagtattcagtatctgctcagccgtggatacactgtacaggaagcccgggattatgccgtcggcggatgtgttcttcatggggttcccggtaagactagctctgtatggccaattgtaatcaactgcggtaagatgcttgaatatgcactccgtaacggttatgatgtccgcatgaataagcagctcgggcccaagacaggtgatttctttcagatggagacatatgaagagtttattgaagcatacaaggcacagtgggcgtactggggggattactctgcaaacagtaaccgtcaatgccgtatccagcatatagagtccttcccggatattatgatgtctgcatttacagatgactgtatcaaacgtgggaaggtaaccagcctgggcggcgcggttcataatgataatacacagtatatcgttccggtaggtgtccaggacttcggcaatgtggcttatgttcttaaaaattatatcttctgtgaggatcctatctgcagcaaagaagaactgatggcagctattgatgcaaactgggaaggttatgaagagcttcatgcaaaattatctgaccttcctaaatatggcaatgatatcgctgaagttgatgaccttgtagatgagggttacagaatcattgaaaatgtatggtatcaaattccttctgcatatggacaccactttgaggttgctcctcattcccttggcttccatgctggaacaggagctaagacaggagccctcccggatgggcgctgcgcatgggaagccatgtcagatggtgcagtatcgcccagacagggaacagattgcgaaggccctgcggctgtaattgcatcagcgggccgcgtagaccacacagagttatatggtgtgctgttcaatatgaggtttactcctgagtctctaaagactaaggagggccgtgaacaactgcatgctctgattcgaacttacttacatgacctaggcggtaagcacatccagtttaatgtgatcagcaacgaaattatgaaggacgccaaacagcatccggaaaaatacacggatcttatcgttcgtgtggcaggttacagtgcgtactggacagaccttaccgatacaattcacgatgaattgattcttcgctcagaacaggaattctccttataggatgcaacttatataaaccgaaaaatcaacagctgggcttcgaaaagtctggctgttggtgtaaaatataagtatacagttcccttgcaaatatgatatacccaaagggcaccccgtaattcatgccccgtggggcgggtttacagcgagctgcaaatattggttgcataagtttgtgagggacatagatgtaatggaaaatgaactccattttcctaaagtgaaactattatttgtaatcgagttagaaatggcccgaaaaacagatagctttgcaggacttcatgagggttcgtttttatacttgtatgagagtgaggtttaagtatgagtacggggaatatattagaggaaattatacccaggcatattttggaaaagctgacggttgttgagttaaaaaagaaggttgtttttattcctttagaggagcagaaggatatcgaactgtattatatattagagggtaaagtttcgtgctttactgtggactttaacggacgggaattcttagttgattcattagggcccggagaatttatcggaaagttctcacaaatgcgcaacatgaattttaactgcggcgtccgaacagccacagactgtaagctgctgaggctgacaccctgcaaaaaggagctgttaagtgataagaacttttccctgtatttctatttgaagacatcggaccgcgtgtacgaaatgtacaagctggcgatgctccgcatgctgttcccttctaatgaggtactggcctactggcttttaaaactggcgaaagacggaactaatattgaagaaaaagctgagagtatctgtctgcagacgaatatcagcaagcggcagtttttctattgtattaagaatttttgcgatgaagggttgattgaaaaatccggaaagcaaattaatattttagacaaggacggcttaaaggacatcgcgggtaatgtgtatttatttatgaatgaaaataaaaaggaggatccggtatgttaaaatccaaaccggttaatttagtaaaacaatttgtatgttatgtatttggcttgtttctaatctctattggcattaatttttccaaaatgtcaaatctagggatcactccggtaagttccattcctcgggcatgtgaacagatctggggatttacccttggtgttacaacaatgattatctatatactgttagttgtactacagctcattatcctgcgtaaacgcttcaaggtaactaacgcactgggtattatcgtcaccttcattttcagttggctggtagattttactggtactgacccaaatgccttcggccatctgctgctcaacttcccgcgccctcagaattaccccatgcagcttgtgtatctgctagtcagcctggtcattagcgccctcggtgtttttatttacttgcgtccccagtggccgcctatgccggcggaaggctttgccggggccatagcaacggttacgggtaaaccctttggaaactgtaagtctatcgcagacacttctatggttgtgatcgccctcatcctgcagattgcatttttaggcggcctgaactcctttaccggcgacggagtcgtcgtacgtgaaggaacggtcattgcagccatcgccatcgggcagcttgtaaaacttttgtccaaaccctttgggaaaccgcttaccgactggcttcataaaggtgatgataaaattgaggcaagagctgtggctgccggcaaataaagaatacagccgttggtttttccactgtaaaatgcccggcagattcatttcctgttttaaaatagctgaatctttatcagcataatgattgctgcaggctaatatgtatacattttcttcatcaatcttatatattagcctgtctttgtcattaatacgcctgctcctaaatcccgtcaaatttactgttaatgtctctggtttcccaatgccttcattgtaataacgcagccagcagcgggttgccataaaaatactcctccgtaaccccgcattctccaagttccctcggatgcaccgccccttttttctgatccgcatggtaatccgatccgcccgacataatggctacccgatccgcataattctcccggatataagactccgcctcgcacttggtcagcgtgccctcatagctggtcttgtcataggtataacaggcctcaattccatccagtcctgcctctacgagccggtcgatatacgctttccttgtcatgattgttccgtctgtttggggctgttccgcaatgagcagtggatgtgccaatatcgcaatcccacccgcacggtgcacctcccggatcaatgcagcaggatccggtttcttcctcttgatctggtatcccggcgtatttcttaccataagcttagcctgcttccaatcctttgcatagcctttccttgccatctgttcaaatatcatcttcttcaggacatgttcctcactcaccggatgccctccgttgtcgagaacttcctcccaggtaatatgcatcccatcctcctggagacgttccaggagtaactgatatccctcacttctggatctggaaagctcccgttcaagctctgcaaaccatgcatcctcccatctgcagccgaggcagactatatgcacgtcctccacatctgtctcgcaggatatctcggtacccagcagcagcttcactccagatgtctctgcgagttccagaagatcaaccagattcccgtcctcatccatatatctctgctccggaacggcatcgtggtctgtcagggccagcacccgtactcccagggcggccgcgcggcggatcacctccggcggagtatctgctccatctgaacgtgtcgtatgagtatgaagatcgcaggcataattacatttttccatagcggcttcttttcctttcttaccataaatattttctttcataaaaatagctttttaccattaagaaaagcagggaccttcatccccgcctaaagtctttcacggtattccttagggctcataccgtacttttccttaaatttccggtaaaaataactggtattgtcatagcccacagactctataatatcagcaaccggcagtgtcgtactggacagcaggtaggcggcctggctcatgcgccgcgcctgcagaagttctttatagtttctgcctgtacgcctcttgatctcccggctcagccaatacacatcgtaaccaagcatttccgccagctcagacagtgttccgttccggtagtgctcctccacatagttcagcacaactccggtcagttccctgtcaaactgcctgctgcccgtctccatcttatccatgtaattcagaagctgaagaaataacagtcccatggtaatttggttacagctgcgtttatttgacaggtcatagaaaatggtccacaccatgttctccaccagattctggataggaagcacgtccgccacatgaaaatacaaataagaggttttctcatttttaccacagagcgtccccaccagaaactccttcagcatattgtcctcttcttccatcatggaaaaagccatattaaaaaattcaggaagaatgataaaattaactgcaatgtcttcttttcccgccggcagtatctcctgcactgcgttctggttgaggaacagcaggtctccctgctcaagaaccacccggtttccatccacaatatgcgtggtagtcccctggcacatatagatcacttccacataattatgtctgtgttttggaaaatttacaaaacgggtgtgcggcctgacctggatcagcttcccctttttcaaaagcttctcacagtccacgatcagttccttcttctccgtataaaggtgctggtcgattccctctcttccgtccaatatcatctgttcttcttccgtgatcacagacaattctctgatcaattccggatgcatgcactcaccttttccatttctgtacgctggcttctgtactctttttgccgtactcctattgctgttctgcaatctctgctgccagttccatgtattctgcggcgctcctgctgcttttcttgtaagccatgatcggcgcattattatcctgtgaccactcgatagcgctgtccacacggatatatgtatcaaaaacctttacctgttccagttccctgagtgtctccagcgtttgcttaaaataatttttccttgtatcaacctttgtaatcacaatgccgcccagctgcagatccggggctatctgctttacctcttccagaaattcaaacatattgccgagtccgaagagcccccacggtgttgattccaccggaatgattacccggtcagaagcacagagtatattcatcacccagccgcccagtgtcggcggcgcatcgatcagaatatagtcgtacacgtcagagtctctgacagacaccaggcattttctcaggatatactctctctgccactttgtaaacagttcatactcaatggaactcatcagcgtagaagacggaataagatccagtccttcatagggagaatgcacgatatagctggacagatcatcctgccgcctgatcccctcgtacaaattcttttccccctgggcaaattccaggacctgttcctcatcaaacagggaaagtgacaggttcagctgcatatccccatcgatcagcagcaccttctttcccagttgggtgagcccataccccacattggaacaggtcgtggattttccgctgccccccttgttatttgcaaaacatatcacttttgtctttcccatctttgcgcctccgtatcatcggcccgaaaccgaatcctgcctctttctgtagcacagtatatcatagtttacggttctgtaaaactctgatttcatatcctcataactcatatcctgcctcgccatgagccacatggccttcgtgatggtcgcctccagggtcatgtcataggtctccagcaggtccagatcctgtttcacttttttccctacttcatacaccatcatatcgctgccctcttttacaacctgtgttgcaacaatggccagcttcccctgcttcccgcagtccctcattactttgtaaaatttatccaccaggtactccggtatgccgccaacgccgaagctttcgattacgatacaccgataccggccaaacagacagtccagaatctccggatctataccggggatcagcttcagcacatagatactgtcctccatctcatgatagaactttacccctccatgatattccaacggcggtatataacggatcacttcctgttcccggatcactgcgggatatggaaagttaatgctggaaaaagcattgtagctctttgcccgttcctttttggctctggttcctacgatcacttttccatcaaaaacgatattaacatctctcgagccctcatctgctgcatagataaaactatccagaagattgtttctggcatccgtattttcctcgtcaatcggtttctgcgccccggttattacaaccggcttttcggaattctggatcatgtacgacagtgcagccgcagtgtaagccagcgtatccgttccatggcatatcacaaacccgtcataatctttataatgatcttctaccgcccggctcatcattttccagtgtgcaggggttacattggtgctgtccacattgcatacctgatgcgtatacacttcgcatacatcctttacatccggaataaacccgaccagttcctcaggcgttatcgcaggcgtcagtccgccctccgtatgtttgcacgcaatggtgccgcccgtccccagcattaaaatccgtttcaatccatagcccccaattctattaccactccagcgaagccggctcgctgccgaaattcttctccaccagagtgcagtattcttcataggcttccgagccttcgaactctgccttcagggcgtccctgatccccttgtaataccagcctatcgccgccttactctgcatacggaaccttttccagagttcatcccccaacaccgggtaatccctgtcgatgtctctcatgttggaaagcttatccgccaatccgatcatcttcacgggcagcggagccatcccaaggtgctggatcgtggcgcccttcctctcttcccagctcagagacttgtcctcgctctcctgcgccacaatagacgctacgcgctccccgaatctcagtttgaggatctcttccgtcacctctttacagtcctcaatcgtgtcatgcaggactgcggcacatataatttcttcatccgcagtcatcgtggccacaatctccgccacctccacaggatgtacaatataaggtcttcttgtccctttccgaaattgcccctcatgcgcctttgaggcaaattctatggcttcatcaatcattcaaacggctcctcctcgatgccttcccgcaatcttgccttttcctttttgtggaataaggcatagatacacggtaccacaaacagtgttaatgcagttccatatataagaccgccgatcgtcaccactgccatcggctgtaccatatctgcaccggaaccaaaaccaattgccattgtggacagacccagaatcgtcgtgagtgccgtcatgataatcggccgcagccttgtccttccggcttccaccagcgcttccttctgatccatcccctgggagatcagctgattcgtataatcaatgaacacaataccattattgacaataattccagataacataacaaatccgaccatagcaattacacttaccggacttcctgtgagccagagcccaagcagcccgcctgtaaatgcaagcggaattgtaaacataacgataaacggtgaccttaatgactggaactgtgcgaccatgatcaagtacatgaacaccactgccagtgccagcatcttaagcagttccaccatggtctcccggatcgtttcatcctccccctgcatttctgcagtataaccatccggcagatcataagacttcatcgccttttccacacggctgctcaccaatccgatattatcatcctcgtctacttctgccgttacattgatatatctgctctgagcgcttctggaaatggactgaagcccatatccggtctcaaaagatgcgatatccttcaacgcaatctgctctgttgacccgtcctgtttttttacatccagtttcatatcccggatttcatcgcgggtcagctcctgattcttttgatccgccactacgattccgatcgaagccgtatccatatccagctttgttgtggaggccggttctttcagtttcttagccaattcctgataaacctgggcaacggtcagattatgggaaactgccttgtccttatctacgatcacccgcagttcttctgtggtctcctccattccgtcggacacgttcttcgttcctttgaccccttccagtatccctgctatatcctttgcaattttctgaagtttatccaattcccgcccttttatctgaacggatatccccgatgcaccgagagaactcatatccatattggacatgctcagggaaagctcaacattttcttccctggccagcttttctatggctttctggatggcgttgtctgacatggaccgtttttctttcagcagtgcatagaattccacctgattcgtcaccgtaccgccgctgcccatcatgccgccgctcatgaccataccgcccacatcaccgatatctttgattttccggagcttctccgtaaaacggtctgcaatctctgccgtatcctgcagcggcgttccgtccggcgtctcgattgacatactgatctccgtgctctgcattgcaggcatgaacgcggttccccttgaaagagaaagcacaccgctcaccacaaacaaaacaagggcgccgatcagtacgaggggtttaaagcgcagcgcgccccgcagtaacttttcatatatgtctttcagatgtacgaagaaccgggattctttttgatccgtctttctcagcagccccgcggacatcattggcacaagtgtaagcgccacaatcaggctggcgaggagcgagtaagcgatcgtcagtcccatgtctacaaaaagctgtcttgcaattccctccgtaaatacaatgggcaggaatacgcataccgttgtcagcgtggaggccatgatagccccggcaacctgacgggctccctgaatggccgcttcctttgccgatgcatgttcctcattgcgcatacggtaaatattttcaatcacgacaatcgaattgtctaccagcattccaacaccgagcgccagaccggacagcgaaatgacgttcatcgtcactccgctgaaatacatcaggacaatggccgtcagaatactgatcgggatggagcatgcgattacaaaagtcggacggatgtcctttaaaaacagcagcagaatcagaatggccagtactgccccaaacagcagattctgcagcacggagccgattaccatgtctatgtagactccctggttcatcagaacaactacctggatgtcgttgttctcttttttaatctgttcaaaacgttccagaatccggtccgtcacttcccctgtggaatatccggtctgcttctgcacctgcagcagaatcccgttctctccattcagtttggcataggtttcatctgcgttatctatccgttctacttctgcaatatcggacaatttaatcggattgatcccctccatgtccaccagaaccagatttttaagttcttctatagactcaaacttgtcccccacacggattaagtagtcgatcccttcttcatttacatagccggcaggcatattgaaattctgagccgccaggacggtctggatcgtctcggcggtcagcatagattttacgtttgccgctgcctttgcttcctccttggccgacttgagttccgcctctttgttctttaactctgcctcgccgactgccagctgggcagatgcctcgctcatctgcatggccgcctccagctgcgccgcggagagctgggccctcgcctgcgccagcgtgatggttccctcgctaagctgtgcctgtacctgtgtcagcatggattttccttccgcaagctcggcctgcttccgggtgatcgtctccctgctctgagccgcctgcccaagtccctgctcaatcgcagccatagattcatcgaaacgctctaaaacagccagctgtgcggtcagcgtcccctttgctatcagcagctccggggtctcaccactctctttaattgcctgttcaacctgttggtattgggattctatctccgctcgctgcccgttcagatcttccagttcctgcttctgctgcagcagcgcctgctcgctggcatcgatctgtgccacagactgctccagcgcagcctctgccagctggatctcgctgagtttctcattgacctccatctgcccctgggtcagttccgcatcgctctgtgcgagctgcgcctctgcatcggccatctgccccgctgcctggctcttgcctgactccagctgtgccttgccgttctccacctgggtctttgcctcgttcagtgcgtccgaagcttcattgaacttattgtccagctgattctgcacggagccgtccacgctgctgaccttgtcttcctttaccgtgatccggatggtctcctcgatatctccgaacgcatttaccgaggccacgccctccagactctcaatctcagggagtacctcttcctctatgatcttcgtgctctccgccggctctttgccgtctacgctgattgcgggaatcatgacaggcatcatggtcggattcagcttcatgatgatcgggttgcctaccgtatccggccagtatgaactgatctgatccagactctcccgcatctcaatggtggcagaatccatattggcggtctgctcaaactccagcatgactgtggatgcattttctcttgatgaagaactgacggttttgatattgctgatggttgccattgcctgctctaccggttttgtcacggtagtttccacttcctccgggcttgctcctgcgtacgtagtcatgacgaccgcgtaggggagattcatatccggcagcaggtccactgtcattttatcaaaggatacaaaccccagaattaatatcagtaccacggctactacaacggtgtacggtttcttcacactgaacttggataacatatgtctacctctttctctttttcgctttatgcttcacccggttcgcctgagaatcgaagtggaggaaggatctgttaaatcccatttatatagaaatcatatcatatgagcaacccaatcacaaccagaaaatgcgggagttttataggtagagaacgcagtaccgtgtcccaaaacatcaaggggcaggacagcggattttgccgggctaaagattatttcttactgtacagactgtgccgtgcacgcctgcagggtgtgaacagtaacgattattttttgtttgtggaatggattctgtgaatggttgtggtgtactttttgtggtacatagagtataatagcaggagaattattgaagtgaggttttttatgggacggaagtgtgttcttattacgggggcgtccagagggattggacgggcctgtgccgccgcttttgggcggctggggtattatgtttttgtgaatagcaggcatcccgatgatctggcaggtgtgtgtggcgagattcgttcggcagggggaatctgccgggctgttcccggggatgtgggatccgcattggatgtccggcgtatctttcaggagattgaggcggaggttcccgggctggatgtattagtgaataatgcggggactgcatttatcgggctgctgacggatatgacggattcggactgggacaggattctgcagacaaatctgtcttcggtgttttactgttctcgtgcagcggttccatatatggtgtcccagaaagcagggaagattcttaatatttcctctatgtggggcatttccggggcttcctgtgaggcggcctactcggcttccaaggcaggggtaaacggactgaccaaggcgctggcgaaggagctggctccaagtaatattcaggtcaatgcgattgcctgcggtgtgatcgacaccataatgaacgcccagctttccgaggaagagaggcagctgctgatggaagaggttccggcgggacggtttgggactccggaggaagtggctgaactggttctttgcctggcgcagggacatgcatatctgactggccaggtaattgggctggatggtggatttttgtaaaaggtaatgaaattatgatgtgtttatgctaaataggttaaattaagatagataaaaggagttgttttatgttaaaggtaaaaggaattgagaatataccaatggactgttctatgacagagtttgtgggcaagacggtcctggatacgattgggcttgtaattccaggtgtaacccccgctttgctggagcagatgcagctgcccaaaccttaccgcagccttgggctgctcagctcccggactggtgcggcgggacaaattaatgccgtagatgaagcagtgaaatcaaccaacacggaagtcgtatccattgagctgccccgggacacaaaaggctggggcggccatggtaactacatcatccttggcggaaacaatgtttccgatgtccgcagagccgttgagattgccgtggaatatacaacaaaatatgcgggagaactctacatcagcgatgccggacacctggagtttacctattccgcaaatgcagaccaggcgctgaatatggccttcggcgctcccattggaaaaccttttggtttcttctgtgggtcgccggctgcgattggccttgtgatggctgatctggccgtcaagtcctcccctgttgagatcatcagatacatgactcctgacagaggaaccagccattcgaatgaagttatcgtggctgtgaccggcgatgcaagcgctgttaagaattcggtactgactgcccgcgaggccggactgcagctgctggtatctatgggaagttatccggagaccccctccgccccctacttgttttaaaatgaaatatccgcctaattggcagacttattctccggcatttctgacagaagagccggagatttcatttttttcaactgtctgtaggcaaatacaattgctatgacagccgccgcggcatctgctatcggtcccgcatacatcactccgtctatccccaggaataaagggaatatcaggatcagcggaagcagaaagagaacctgtctggtcagtgacatgacaattcctaattttgctttgccgatagaggtaaagaatccggaagacataggctgtatgccgtttgcaaaagtcatgaacatgaagatctccaggtatctgtctgcaaaatggaagtaccgctcactgccgctcccaaaaatactgactatctggcgtgggaatatctgaaaactcaaaaagaataatgtggcgattgtggtgcataaaatggctgcttttttgtatgtactcctgactctctcatagtttccggctccataattgaatccccagatcggctggcagccctgagagattccgatacagattgccagaaacacactgttcactttcgaaattacccctacgcaggccagcgggatgtcgcttccatatgaggaggcagctccataatagcggagagtattattcatggcaatctgtacgacagtcatagcaagctggttgatacaggatgccattcccagggctgcaaccgcctttagatagaccgccctcgggcgcagagcggagactttcatatccattttcttatacttcacaaaataaaggataacaagaagcccggaaactacctgaccaatcactgtagcggcagcagcacctttaatcccccagtggaacacaaagataaagaggggatccaggattgtattcaggattgctcctgtcaacatactcaccattgaataggtggggcttctatccgcccggatcaaatgatttccaccagttgttaatataaaaaagggaattccaattgctgttatccctgtatagtccacggcatagggcaggacttcgcttgtcgctccgaaagcatgcagcagatgctctaaaaacaggagaacaatagcggcgattaccacgccgctaataacaagtgtggacaggccagtgcctgcaatttcactcgctcttttctcttttccagctcccatttccagattatagttcgaagcgcttcctattcccagcagaagcgctgtcgccgtcgcaattgttgtaacaggaaatgcgatatttgttgcggcatttcccagcataccgactccctggccgataaatatttgatctactatattatatagtgcacttaccagcatactgatgactgccggtacggcaaactttccaatcagtctgccaataggttctgtacccagcggattttgatttttgtccgcggcgctcttctcatatttttccataaatctcctttgtaacgtaggcctttaccgaaatcccctccgccacatattcttcctccagaagctggccatgccttcggatcagctgtattttcccggcttcctcaaaaggatacattttttcgatataaatttggccgctgcgtatgatttctaaaagtgctgttttcagttcctcaagcccctgcccggtctttgcggatgtcctgatcgaatactgtgcctggaaatccctgaaactgcctgcttcctccaatttgtcctgcttgttaaacagtgtgatcaccggtttgccttccacgcccagctggcgcagcgtctcatataccacgtacatctggctgtccatctgtggattggaggcatccactacatgtatgataatgtctgcatattttgcttcctcaagcgtgctcttaaacgcctctatcaaatggtggggcagcttccggataaaaccaaccgtatccgtcagcagaatctcctgctttccctccagctccagtacacgcgttgtcgtgtccagtgtcgagaaaagcattgcatccgccaggattccggccccagtcagcgcattttctatactgctctttccggcggatgtatagcccaccagagcggcgatcttcttctgtgacgccttccgctgggtgcgtatcaattctctgtgctgttccacttcacagagctctttcttaagccggctgatccgttcccgaatcagtcgcctgtccatctccagcttcttttctccggggccgcgtgttccaatccccccgccaagccgtgacagggaatctctgaggccaaccagacgcgcagcccgatatttcagctgcgccagctccacctggatcttcccctcgctgctgaccgccctggctgcaaagatatccaagataagaagcgtccggtcaatcaccttgcactccagctcccgttccaaattgtggagctgcacggacgtgagttcgtcatcacatacgataccggttgcttcggtctcccacagaacttctttcaattccagaagctttcccttccccacatatgtgaccggatgcactgcctcgcgtttttggatcacacgcccggccacttccgcccccgcggtcttcgccagttctgccagttcatccagcgattcctccgtccgctcattctcatagagctgaatgcctacaagaatcatggattccttttgttcctcaatttcatataacgccatattgtaatcccatcaaaggggtctgacccctttgcccttcattttcagaatattctcaagttttaaagatctgtttgtccagatccgctattgtaatctgccgcagacgcctgcggcactgctggtctaagtctttatacaaatcttccatgacacccgccatgccggaagctatcagacatttcatctccgagctgccgctcttccatcctgatgttacaaaggaaaattccagcgcatctgcgattgtacaaaggtctgtttcctcactatttttcacaaaaaggtatccaccgtctattccttcttttgtctccaccagtccggatttttttagttttaccataatctttcgtatccttgcggcattcgtacaaatattttctgccagcccttcactcgaatatacagttcctttatgatttaaaaaaacaagtgcatgcactgcgatagaaaattcactggtcatctctctctcctgtttcactgataatttctgctgattttcatattataaatcttttccctggatatttcacctgttttatgcactatgatatgaatttatttcagcctgatgagaaagacaggaatcggcgggtcattctgcctgttgtaaaactgatgaacgattacaagccactttcttggatccacgcctttcaggtaatcgagaacggcttctttctcctcatatcccgaatccttcccgctgtatatgcagaggctcatcacgccctctgccttcagaagcttcattccctcctcgactgcaagtatgcttgtctctgcttttgtggagatccggtgatccccgccaggaagatatcccaaattaaaaacgatggcagatacgtcttctttcacgtaatctcccatcttttcatgtccgtcccggatcaggcaggccctggatcccaatcccagcctttccagtctctctgctgtatgtgccaatgcctcctgctggatatcaaacgcatacacctttcctgtgcttcctgccagccggcacagaaactctgtgtcgttcccattcccggccgtagcatcgacacagacatctcccggttcaatatacatctccagaaaccgatgacagtactccgttatctgataactatatttcatacccttctcctattgttcatgttctctatctggtgctgagaaaagctgcctctttctgtgcatcctggtcatcaggatactcgctgacatactcctgtattttaatcttcgcattctcccagtcatgtaacttttcataacatacgacttcattaaacttcatttcccggatcacctctgcatcgtccgtctcttgcgcccccgctgtatccccagccaacttaattccctcaccaaatgcgtccaatgccccctgcgggtcattcaaatgcatagaacagactcctataaaattataaagaaccgctgttgcttttccgtcatgatccaataccttctgaaatgcatccctggccttctcataatcctgaagctcataacgtgccatcccgagtccacggtaggcttcagccacatctatcttttccgcttcttccttctttgaagaaccggctgcctgctcagataaacggatcgccttctcaaaagaaccggctgcctcctcatactgatgttcctgcaaatgcgcggtaccctcggacacatagtccattccgccgctgcaccctgtcagcagaaaaacagccagcacagcgtatattataacttttctcatatatgctccttttattccggatattttaatacccagaatgaattcaatatattaatcaacatcacagccatatccgcaataatggcattctgcatcgtcacatagccaagcgccgccaaaaataagagaataaccttcatgcctatggcaaacaccaaattttgttttactgcgcggatcgtgccctttgaaatcttaatcgcattcacaatcctagagggttcatcttccataaggataatatctgcagcctccaatgcggcatccgctcccaaaccgcccatggcaatcccgatatctgccagcgccagccctggtgcatcgttaataccatcgccgacaaatgcgagtttttccgattccatctggctttccataaactctttcacctgctctaccttatcttccggcatcaggttcgcataaacatactcaatccccagttgttttgctgcatcatccgccactctctggttatctccggtgagcatgactgactcaatctggtgtttctgcagccagcggatcgtccattttgcatccggacggatcacatctgcaatcagaatatatccttcatattccccatccacagccacatgcactactgtgccgatctcctgtaccggctgatagaagaagccccgctggttcataaacttggaactcccaatgtatacctgcctgccgtcaatctgtgcacagacgccaaagccggaggactcctggatagactccaccctgctgctgtcgatcgacttgccgtaggcagctctcagagacaccgcaatcggatggttggaataggactccccgtaggcagtaatttccaataggtcagcgtcctccatatgcttcggacagatagccttcacatggaaaataccttccgtcagcgtaccagtcttatcaaaaacaaacgtctctgttttcgaaagcgcctccagatagttgctccctttgatcagcactccctgacgggatgctgcaccgattcctccgagaaatgcaagaggtaccgagacaagcaggccgcatggacatgccgctaccaaaaaaataagtccccggtaaagccaggtctcctgatccgctccctgcagcatcaagggcggaagaatcataacaagtacaccgatcagcgtaaccaccggcgtataaaaacgggaaaatttgtctgcaaaactttcactctgtgccttattattgttggcattctccaccagttccagaatcctggatgcagtagaatcttcatataccttggacactctggcctccaacacgccgctgatgttaatgctgccactgtaaagccggtccccgatcttcacttctcttggctccgactcccccgtaagggcttttgtatccaccatgctcattccctgcgtgataaccgcatccaccgggatccgttctcccggcttaattacaataatttgcctgagccgcagttcccggggatgtaccttttcctctttgccacgtatcttacggttcgcatattccggacgtatatccataaacttcgcaatagacttctttgttgcggacagagaaatgacttctattgtcctgccaaactggaagaacaggattgcgccgactgcttccgtatgtttgccgattgctaaagcgccgacagtcgcaaggatcatcagcagattctcatcaaaaatatgtaatctttttacgttcttcaatatgtcccagaatattcccagtgacataaccagatatgggagcaggaacaaaagcaattctgtcctccccgtcatatcccagtgcctgaccgaaaacaatgcattgatgtataatagcaggccgattccgatttcaatgcatttctttctaacttcccttgccatcttggcccccttattttcctttctccatgattctattctctgatatgttccaatccctggttcataatagtcttgatatgaccgtcagcaagagaatagaacaccgtcttcccttccctgcggttcgtaaccagcttcatctgcttcaataccctgagctggtgtgagatcgctgactgcgtcatactcagtgactgtgcaagatcgcacacacacatctctgactgccacagcatacataaaattttaatcctggtagagtctccaaacactttaaaaaaatctgccagatcctgaagctcctccggtcccggcatgttctcctggaccttctttacaatatcttcgtgtacatgcatgaaatcacaatgttccacttccatttttcccatataccgaatctcccttcatgtgaacaaccgttcagatattattatacgaaaaatacgctgccgggtcaagcaatgcaggcccgtctgtcctttatatcattcccatttttctggatacttataaaaaagaaacgcatactcaacggtctgcgtttctttcttaagttttattatttatttcccggaacgttcgtgttacagcttcttataaagcactctcacagaattcaaaatgcagagcaccgccactcccgtatccgcaaaaactgccatccacatgttggcgaggcctgcaaggcccagtatcataaccaggattttgatagccagggcaaacactacgttctgccgcgctatggatcctgttgtccttgcaatctggagtgactggggaattgcctccatagatgaagtcataaataccacatccgccgcctctatggccgcatctgccccgcttcccatcgcggcgcctacgtcagcccccgcaagaaccggtgcatcattaatcccgtcaccaacaaacattacgctgccatgggcctcgcgaatacgcttcaattcttccaccttattctcaggaagcagttttgcatggatttcatcgattccggtctctctccccaccgtctcggcgctctttctggcgtctcccgtcaacatagcggtaagaattcccatccgtttcatagcagccaccgccggtttcgcgtctgtcttgatcgtatccgcaatcacaagttgccctgcatacactccattcagcgccagcagtacttccgtaccgtatgaggcatctgaatactggcctaactccacgtcatatgcttccagcaattttctattgccgcatagtacaattccttcgtccaactgcgcccttacccctttcccagaaatctcttccacggataaagggtgctgcaggccgattgttttctcctcagccgcagttacgatactcacagcaatcggatgtgtggatgtcatctcgcagctgcccgcaagagccagcagcctttcttcgtcaaatccggccgccggcaccacattctgaaggacaaagtttccttccgtaatggttccggttttatccataacaatggactttacaccctgcagagcctcaatggcgaccccgcccttaaaaagaatgccttttttggaacctgcaccgattccagagaagaatgccagcggtacgctaagtacaagtgcacagggacagctaatcacaagaaatgtaagcgctgtatatacccagtagttccagtcccctgttatcagggaaggaatcactgccgttgcgattgcaagagccactacgaaaggagtatacactcttgagaacctggtaataaaccggtcaatcttcggtttgcttgccgccgcattttccacagaatccagaattctggtgaccatggaatcctccaaaatcttatcagcacgtattttcaagagccccgatgtatttacacaccccgatgtaaccgcatccccggccttggctgcgacagggacgggctctcctgtcaccggtgacgtatcaatccggctttccccctctacgatggtgccatccagaggaatcctgtcaccgggccgcaccagaaggatatcacctatgcacgcttcctccgcaggaatcaccagaatctctttcccagccaccttgttgactacttccggccgcatgtcaactgcatccataatctggctgcggcttctggagactgcgatttcctcaaacagttcccccacgcggtagaaaagcataactccgacagcctccgggtattcgctaatcagaaatgcccccagcgtcgcaatgctcataaggaaattttcatcaaacacatggcctttgcccaggttttttgctgcagtaaacagcacagcccttcccagtacgagatacccggctagaaacaggatcaacgagagatttccacttaccgtttctgtcagtatccctcctgccataaaaacagctccaatgccgatctcccagaaatccttcttattctcactgaatttccccttagatgcggtttgctgccgggtcggttttctatctcttttcaagacagtaacttcattctctatggaagaacagatttcctgaaataccggaagcagttcctcctccgtattggtaaccacctgcagctgctttgttgcaaaaataatgtttgcaaaatcaacctgaggcagctcctgtattttccgttctattttagctgcacaatttgcacatcccaggttttccagaatataaacctgcttctgtacatggtcaaatgcatgattcacctcacgctgttccagcgcatcatgactatgtccgtcaccgctgtgtccgctgttttcatggctgtgtccgtcactgccgtgtccactgcttccatgagtatgtccgcagctgcagttttcgccgtgatgatgctcatcctgtccatggctgctgtggtgatcatgatgacagccgcatacttctccatgttcatgtttgtgcttatgctgatgctcctgtgcttcctcgtgctgatgtcctcttagatccccgtaacaatgttcttttccggaattgtgatcatacccacatccgcaagccgtattctctggatacgtctttttattcaaagcctgttgtgccatagtcgtacctccaatgcttatacatatgaatacctgttcatatgttcatataatcacactcagcacaaaatgtcaatacctatctataaaaatttaaaaaatttccctgtcaaatacctaaacacttctatttttatgccacagtccttatcaagccggcagtgctttttaataaataaaaagccaacatgttgaccaacgccggcaaacacagcggtgcagcctgcactcccgtatattccggcattgttcaacatgtggcttttattatattgagatactgttacgcgtcagctccacgtccatggaatcctgcttcagatctctgcagcggtctgataccgtcgcctagaatcccctatttatcgtccaatgatctcattacttttttcacttcttctccccccaatgacattagccgtaatgtcatcgagccgctctttctcttgctcgctgctttcctctacaaggcatgcctgaatcgcctcattcagagaaagcatcttatcatcaagttcagcaaccatctgtgcacattcccggagatcccggctaatatagtccggcgcattcccttcgaacttataataaatcttatgctccagacttgcccagaaatccatagcaattgtccggatctgtatctcaactttggtatccacgacactgtcagataagaaaatgggcactgaaaccagcatatgatagctcttatagccgctctccttcgggttctttatataatctttaatcgaaagaaccttcagatcgctttgattcccgatcatctcggccagacggtaaatatcagatgtaaaagaacagatcagacgaacccccgcaatatcattaatatatttaaccatattctcaatagatgtctcatgtccataccgttttagcttctttacgatactctccggagttttaatacgtgtcttaatatgttctatcggattatactgatgtacatgctgaaattcatcgttcagaatctccagctttgtcccaacttctttcagcgcagcattatataaaaaaataaccgttttccagctatctacatcttcataatttttgatagcatcgtgcatctgcagttctcctctcaatttggaaaatccccctttcccaatcctttctagtatatcataaaacagacttcgtgtcagccagttcatttttttttaacaaatcgggatttagtcggcaagctttagacttgtcgacggacggggacgcttcatgacagggaggccggggaggcgctggggctgtatatgccgttgcgatatgcacccgtgctgctaagtgattctagaacacccgatgccggataggcgggtacgctgaacacatcacgggaaatctgatgatttcccgcgctgggttcatcaaaaacttgatttggagatcaagtttttccccgcctatccggcatcggctgttcaagaatcactaagcgcactccagcatatcgcaacggcatatacagccccagcacctccccggcctccctgtcataaagctggctcatccaatcggcaggaaagctcgccaaccgggtgggatcccggaccagggcagcggatgtggattggctatgcgtatcttttcatcttcaagatgtgtattgaattattttgatactggaaccgtatcccaacataaaagtcccgccaatttaataccatacgctgcccccgtttgaggccccaccttaggaacgagtccttttcctaccggttggatgcgccagctccatgaagggatagctgaaagcctcccggagaacatccatgtcctttcaaaaacgctcaaagcggatcttagaaattcttggtgggaaacagcccggaaaatggagagatttttggattccgaatccaaaaatcagctgacccagcgcgagaaatcatcggatttcgcgtgatgtgtcagtggtgctccattttcagggctgtttcccgcctagaatttcttaggtccgcggccgcgtttttgaaaggacatggatgttctccgggaggttttcggctatccctttatggagcgcccccatccgcgccgagactaaagctcgtcactaaatcccgatttcttatagttccagcttcatatccccaaatttaatccattttcgtttccgcatgaattcggatatgcccagcgtcacaagcgctggaagcaggatctgtattacaagtattttaatcaataccatcatggggggttccgtctgtgtcatcacctgccaggtcatgatctgccccacaagccctgctgttcccattcccgatccggttgcgttgtttgtcatatgcagtaccatagtccccaccggcccgagcaccgcgctggataatatggccggcagccagataattggcttccttacaatattaggtacctgcagcatagatgttccaatgccctgtgcgagcagtccgccgattttattctcccggtaacttgctacggcaaaaccaaccatgttgcagcaacaacctatcgtagcggcacctgctgccaatcccgaaagattcagtataattcctaacgccgcagaactgatcggcagagttaggatcatccccataagcacggatactacgattcccataaggaatggctgctgctcagtcccccagttaatcagtgagcccagccagttcataaacctggatatcggaggacccaaaaacagccctactgcggagcctgtcccaatgcacaccagcggggtcagtataatatccagcttcgtctttccagaaattagaataccaaattcaatcgctatgtaagccgcaacaaaagcccccagaggctcacctggtcctgcaaagaccatggcgccgtcctgtatcacttgtccagccagaagttttcctgcaaaagcgcccaccatacctgccgtagccgccgataccgtcaccagctggccggcatccagcttcctggccacgccaactccgattccggcccccgtcaaagcagccgccaccttccctaccgcataaaccaggtctcccccagtcccgcccataaaagtgccgatctgctgaattattgttcctataattaaagtagcaaaaagcccctgggccatcccgctgagcccgtctatgaaaatcctgtcaagcagcttcttcatccgaaaatccctcctgcacatacacttgtcttgtcattccccgctattctaccacaaatcccccctcccgtccataacctctgtaaatactccacagtcatgtaagcctctgtgttacagttaccccctgcgggcgcgcacagtaacaatcctcaaaatcacaaacaccgtcttagatagaaaaccctttctccgctccaaatagatatccgcactgtcggaagtccctagtatgttcaaaaaaagaatgagggtcagccctttttagataagggggctgaccctcataattcactccccgataaactgaaggaatttggcgatccgttcattttcttttcttacaatagagaagaagttttctgcagtttcgtctgcagccgcgattcctttatccataaagatgatcctgcttgcaacatgtcttgcaaactgcatttcatgcgttacacataacatacagaccccttcccctgcaagtgtctcgagtatcttgagcacctcgctggtcatctccggatccaatgcggacgttacctcgtccagaagaagcgccttcggattcatcatcagcgcccttgctatcgcaatcctttgctgctcgccgccggaaagttcattgtgcatggcttgtgcttttgattccaggccaacctttttcagataaagattcgctttctcctctgcttcctttttattcatcttcaggagcttcaccgggctcatggtcagattctgcatgacgtttaagtgcggaaacaacacggttctctgaaagaccatgccgcagtccagacgtatctgccgcagattctttttctcttttactgacaacccgtttacgaagatatctccgctgtcaatcgtttctaaagcgttaatgcatctcaaaagggtacttttccccgtgccgctgggaccgagcagaacggttacgccctcctggttaaaatcgacgctaaagtctttcaaaacggtcaggtcaccaaagcttttggtaacgctctttacttcaatcatagacattttttatgtcacctctcttatcctggtagcagtactgttttaatagtggaacgataatttcttctccagactctttgccagcctggacagcggactggatattacgtaatagatcagaaatacaattccatagatcaggaatggctttaaggtacgaagagccaaattctgtcccagttttgtcagatccatgatacctatcagtgcaacgagtgaagaacactgtaattgtgatatatagagtgtaatggcctgaggcacaagaagtctcagggcctgtctggaaattacatttataaaagtcgatattctgctgtgccccaatgccattcctgcctcccactgcccttccggtatcgcggacacgctgttgtgtaccagaacagccataaatgccgctgtattcaaagacagcgccagtattgcagccggaaacggatccagcatgatccccccgatcatcggcaggccataaaacaccaaaaacagctgtgtaacaaggggcgaattccgcagaggctcaattactaccaggggcagtacgctcactactttattcctggaacaccggatcagcccgaggatcactcccacgatagttccaatcagcagggacatgaatgtaatatatagggtaactcctgcagcccgaaggaactgcatggcatcattgccggtcagatttgcataatcataaaatgacatctcagtccctccttataatacaatatggatttttctatcgatgagcttcgcaataaatgaaatgatatatgtaaaaatgcaataacatagtaatatcatcagataaatctcgaagggcctcgaagtcctgccaacaataattttagccgctcccatggtctccactaccgtaatagagaaacagaccgaagaggtcaggactagattgataaagttatttacaagagacttaaaagcaagccggaaagagattggaagtacaaaatacaagagtgtctgcatttttgtataccctagcgcctcggaacattcgaagtactctttcttaacagccaaaagacctgcccttatgatttcgcaattctgggcacttgtgttgatccccagggcgatgattgccgtcgccatcgcatccgtctggattccaagtgccggaagtccgtagaaaaagaagaaaagctgaaccagaaatggagtattccttagaatatccacatagaccgtcgctatgatgcgcagaatacggctctttgactgtttaaacagtgccattagcgttcccagcacgagcccgatcaagaggcaccaggctacaataattacggtcatcttcattccgtccagcagcatatccccatatacattgagaaaattaaagtttaatttatacattttaagcaccctcacctcctcattctattcgtacactttattcatgcaagaatgcccgcccaatacaggcgggcatcttccatgcagctcgtttgttaccatagataatttaactctgccggtttggttccccaccatttctcatacgtctctgtctgccatccagaactgatctgccatgatacaaacatgtccagatagcgggcaaattctatatcccccttcctgcatgctgcgcagatcggatctgatgtatacattttctcctgtgcttccagcttattgttctgggatgccgcatattctactactgtattatcttcgaaagccgcatccgcttttccctgttcgacctgaaggacagaatccgtaaaattatctacataaagaatgttcgcctccggagcattttctgttaccaatgcctcaccggtcgacccccggttaaccgataccgttacatccgggctgttcagatcttccagtgtatgcaggtctgatcctgctgccgtcagcatcttgataccggcgcggagatatgggatcgaaaaatcaacagactgtgcacgttccagattgcctgttacatttgcaaacaggacatcaacacgccccgatgttaatgccggaagcctcgtttctgcatctacatttactatttccacttcaaccccgagtacttcaccaagccggttggcccaatctacatcgtatcccatttcttttccactgtcgtcggtgaatccgattggcgctccatttaaagaacatcctacaacaagtttccctttttccaggatcgaatccaaggttgcgcttccgctgccgccttcttccccggatgccgctgcatcactggattttccggattctttcttaggtgagctgcatccagcagccatgcctgcgattaatccagccgttaacatcattgctatcacttttttcattccctttcccataacttctcctccattctttaacaatctttggtttcactgaatcttctacttttgaatccactgggggctgtcggtcagctttctggctcccgtatccgtgatcaggtatccgtcttccatcctcattcctgacacatctgactcgaacagcgggatgtccaccgagattatcatatctttctcaataacggttctgctggacggtccgaatataggtggttcaaactcaatcacaccgacactgtgaagtccggagtacataaagtttttttcatatcccgcctccttcatcacctgtcttcctatcgcctccacgcagcttccaatttttcccgggatcagattctctgcgcacaggttttgcgccttagtcatcgcttttactgccttctccgccttttcacccggattccccaccagaacagttctcccgcaggctccatgatatccttcataccttggagcgagcgtaatcaccacaatatcattttcttcaattaccctggtcgtcgtccgtgcaagaacatgagccgcattaggtcctgatgagacaatcgggtcgattccataaccctcacagccctttttccgcataacatactcggcttcggctgcaatctccctttctgtaatgcccggtctcactgccgcaatcgccgcgtgcatcccctcgttagtgatctcgtatgccctgcatatgacagcgatttcatctggggattttatgcctcttaaaggcgccagaaacggatctgtgtccaccagttctgcatcaggatatgcccgcagcagggcttcatacaattctgcccccatatgtacctttgctgccagcccgatccttttcggctctcttcctgtatactgccggatgatctcctgcagtgactctacctctgaaaacgggtaatcttcatcctccgccgccagttcagtcaacacctttaccccaccggcaacagctctctcccctgcatacccgtccgtctccggccccgttaagatcacgggctctctgcccgccacaaacataaccaacaccggctcaaagtgtgtctgaaggtctgtataatatctcgcatatgcattgccataggttgctctgtcatcgctgtatgccagaatgatgtccagtttttggtcccgcataacagcctgcactttttcccacctccgcgggtactctgtcctcggaatcctgattaactcgtcctgcatgttacatctccttttcattttttctccgtgcttctttctctgcacttatttttcaaataacttgaagactgctttccggtgtcccaccatctccttattgtcatttacgatcgctgacggatataatccctcaagcttttccgcaacctcccggttgttataaccaagctcttcgaacactctgaggaccgcggctgcaaattcatcatgactgccatccatgatttttacaacggcccccactccaagcgaacggatcccgattacgtatacccccagagcgccgctttttccaagcaggtcactgctggatgccagaacagaacatacgatgtcctttcctgcaatcatatgaggatatttatgaatcatatttacatttttgatcaccgccgtccgcagtaccgaatccggaatcagttccgggcacaccagccgcagataggatgtcgctatcgagtggaacggcacggcatataccggaacaccgcagccatccacacctgttttaatatcctcctgggccacatccgtcatcatggagataatccccaggatttcctgctgtgtccggctctcccgcttccagtatccggttacctcttccccaagctctctggccagcagcatcatacccagatgtttaccgaagcaattgtggtatatttttcgaggcggcatatgattctctatcaggcggttccgctccgagatccggtttggatattgtgatacaatggataacaccaataaatccgagaaaaacagttaattgtgcacaatattcgttctttttcatgaaattctctatccatttcctttaattatactcatattgcccgggatgtcattattttatcttgtgcaaaaatgtcactatcttggcttggaggaggaatttcaaatgataaacaagataaatcaaaaagcgcagaatctcgtagactttccgcagtatcaggatactttggctgaaacacagactggatctgcctttattcagtacaatcttgatgtcacacccgattcgcaatggttcatcgcacacacgaacccaaaggccagggcacgtctgccatacgtgcaggaggtcggggagttcgtaacgggaaaaaattacatgacaacccggcagggcttacagtcttatctgctgaaaatcacgatggatggaaaaggctatatcaacttcgacgggaaacattatacactttcccccggacagtttttctggattgactgcaggaagctgaattattatgccatcgatccggacactccgcactggaatgtgatctggatgcatttctggggaaactcgacgcatgactattacgatagcttcatggagctaaataacaacagcccgatcggaaccatgagaaacaacgatgccatccagctgctgcggaaattaatcggttactacagcacaaacatctacaatgattaccagaccgacataaaagccgcgtccatcatcacaacattgatgacctgctgcatggagtctgccatacacgataaaacaatgtccctcaagaagcagccccccaaatttgttccgcaggctcaggagtatattacagaacattttaacgaacggattaccctggactctttagcagaagaattcttcgttaacaaattttatctgcagaaacagttccggctctatgtcggaagcaccccgggtgaattccaacgcagtatccggatcgacaaggcgaaagagctgctgcgtgtcaccacaatgtccatcaacgacatatcggaacacttaggcttcgaaagcgtcggatattttatccgctgctttaagaaagaagacgggaagactccgctgcaataccggcgggagtggggtgtctaaaaagaacccggacggagcccgctgccacataaactgtaaaccagcggccacacctggagccggccgccgcaattctttttttgtttctcccatcggaattatcgcacgaacacaaaagaggctgacgcactatatagtgcgtcagcctcttttcaaacatactctagcgcaggaacacgccttttttcatgattagttcatcgtccaggtacaaatcgggttccaggatgattccatccatatggcagtccgccttattggtgccgccaaatgaagtattgctgccgaaagcaatatgaacagttccatacactttctcatcctccaaaatatttccgcagaggacagctgcatgatttgttcctatccccagttccgctgtaatgccgttttcaggttttgcaaacaggatctgcaatgccccgccgtctccttccaggcttttcagccggcccttttcgattgttacggccagtggttcctcaagtactcccattgcttccattgagccgtcgatgaccatgtttccgttcacaccgtcttccagcggagcaatgtatgcctcccctgagggaagattgcctgcctcgccgggattgcggtaaacgcctgtactggggacaccatttcttcccttcagattcagggtcagaacatgtccgtccttttcgatcctggccgtggatgcctctgtgagcatctgggcgtaacgcttcgtatctgcttctacttttcgaaagtccgcagtcatcgcgccttttgaaaacatttcctctgtaatccctggcatagtgccaattctcgcaccggcctttgcagcgctgatcctggcattggtgtgtgtcatagaatgctctgtaatgcagatcaccacatccgatgcacacatggccgctgctatagctgcaggcggctcttctccggaaacgctccgattcttcatgcacataaaaagtgcctcgcagttcatacataaggcggtctcatacacctggtatcccagatcatacttatcctgatccgcgaccaccagcacctgctcgccctcttttacatccatacaggccataaggagattctctgcgctttccctgatatccatctccgtttttcccgtcttcatttcagtttccttctttctgctgcattttattaacagttattctgcttgcttcaattacgctggataatttcatagtgtacggctgcagcttacttatttatgtttattcccggccgtctcccaaagtctgcagttttttcatggatccgtatagtttctgaatacgcgcaaattcctcttcatcataaaatctgcactgttttctgccatatgacttcgctgcctcaatcacaaaccgggtcgtcatttccacatccgcaccatgcgtggcgccagtgccgcatcccggtaccgcagtctccgttgtgattgcaactccaaccacaggaacatccgtggcaacagccggctgaagcacgctgttaaggtgatagaggtcatttccgtaaggtgtgatgtcctgcgtggtaatcggaaatacataaggtgcttttcccgtcgttatctccacaatgtccagcaagtcctcgctgattctgaggatatacccctcctttacggttggagatattgcaaaacccttatggttaatcacacggttccccttggtcgtatcgactgtcaggatcgcatccatatcctctgtaatctcttcgtcattgcactgctgcatgctgaccggtgaatccatgaagtccactggttcatgtggttcggtcggcgcatccgcacatacgtgtgtcacgagaaccacatctccctccagcgtatccccctttttctgcatgtccagaagcttggctgcggcagtaagtacggtcagtgcgccgtcaccgtcagacacgaaaccgatccgttcgggacgcgcaccaaggccgcccagcctgccgataatcccaagggtcggcgcatcgccgccgcttctttttccattgcttccatgcacacataccttgaccacatccgttttccctttgtctccgtagatcggatatgcctccacatccgcatccttctggatgcttctcaagtattcctctactcttctgccatctgcattgatatcatccagaatatcatagagttccagcatctgcttaaaaaccattttctcatcctcgcaatttcttatattgattcttcacattgatttgtgaaatcttctgttatataatttgttaaaacacacccggaggtttttcattatgagcgttattactgtatctgacgttctgcacctgccctctctgtccggcgccaggattaaagccggtatggacgggctggacaggccggtagaatatgtcagtgtttttgataattacatcagcgaaacagactttgcatcgcttgacaccaaatccaggaattccttttttatgacagctttctatcacggcaaagacgatccccagtacatcctctatgccctgaagtattttcatgccattcacaccgcagcgctctgcattattgacgaaaatatggacgaactgcctgaagaagcttatgcttatgccaatcagtgcgaactgcctatattatttatcgacaaggatgtcccttattccattattatttccgagataacggaacagctgctcttttacaaaaacctgaacagccaggaggagatccttgcccagctggctgacagggagctgtctgacaatagaaaagcaatgcttatccagcggctgaatccttactttgccaaaaatgtattatgtttttactgccgcgtggaggcaggcatgccactgccccgtccggctctggccgaaaaattcagccgggacgttttgttttttgccgcgggttaccggggaggcattttgattatccgctcttttaaggataattctccacatgcgattgataaatatatctcacagactgcggcagccatctttgaaagctatcccgaatgtatggcgggcatcagcagctgctgtcctctttacagcctgggggatgccatttcacaggcataccacgccgcttcttcctgcccgtaccagccaggcaaagtcatatatttccgggctcttggagtactacgcctctttttaaagctggaaggccaccctgccatagatgaattttatatggagacagcgcagcctattttagattatgatgaaagataccattctcatctgatgcataccattcacgattttattgagaatgatatggactataccaaaacaagcaaggcgctctttgtccatgaaaacaccatacgctatcggatcaacaaagtaaaaaatatgatcccctacgggcagagcgataccgattttcttcagactctttacatactgtatatcatccgtaagttaaaggattattaacgcagtcccgctatttggatttgaatgctcccagcatggagttggcaaaatcatgcagcgcacatccgaccagggagcccgcgccaagaatcatcagtatatcatcgtttttcggattcttcttaattacaataatacggatgatagtggcaatgatgacggtcaatccatatatggttccgcctactaggataccggtggcaaacaggattccaacctggtggtttcctcccgtgatctgaatgatggcccccggaattgcccagatcgccagccatttcaatacctcaattgaggaacccgcttcaatcgtggaagcatatgtagcgttaatcggcgggaacagcccctgtgagaagtatgtttttgcaaaaatagcaacaataacaaatgccactgcaaaaccaagcagctctgaaaaatactgctgttttctgcctgccttctctatctccggattctttccgcttcctctcagtatatagcccgcttttaggtcattacccatgtcagagaaacacggtcctgttgccgcggtaaaacctgccagtacagccagagggagctttggaaaaccgatcagcatccccagaattaaaaagatgagggccgtggcgaatcctggaaaccatccggaatacatagcggataccccgacgatcagttcggatacaagcgccgctaccgctgcaaatataatccataagataaacatgcccggcttcatctcataccacagccccgatacaattgcaagtcccagggcaatcaccagataagcgataaatccttttccaagagcactccgcatatctttgatcgaagttccaaactgggatgccgctgaagtctctttatccactttcttaaacagcattctgccgcactggatcagggatatgatacctgccccaatcatgatgccatgccccatataattcaaagcaacatgatctgccgcaacaaatccttttccaaaaatatcctgtgcaatgacaaattcatgtccgaacacggtaaatgcaaacgcattgctttcaattattcccacgatcagggcgcctacaccgaatgctccgatagccagtacgcttcccacccatgcaacgccgaataaatccataggtattccggccatagcccctgcccatccggcaacagcgccgaccacaagcagcccggcacgttttccctttctgacagttgcaagaatcgtttcagccgtagcaattccaggaggccacggtgcatcagccggaaacatcggcgatccgaatgacttgtacaaaattgtagcatccacaattgttgcaagtgttacaccgatcagcatcggatacatgaattccgtgtatcccataatataaggaacaccgatcgtcagcagcatacagtttgccgccgagaatgttgcccctgatgtcgatgtctgtaccaggttctggcaatggatattcttaaattttttcaaaagccggatgggaatctgactgatcagaactgcaagcagcgctcccaccacagaagtatccggggctacccccgtatgtgtcagtacctgcattcccacgatagctcccagcacactggctacgacggctataataaaaatgcccggttccattaattttggcatttctttggagtactgctccagtatctcttcagagctgccattttctctgttgtcactcattgttctctcctttcccttttgcacgatttacaccgggtagcgtgtaaacatagtaataattatacaatttttcttatttttatgctttgttgatttctacaataatttgatatttatttttgtaggattcagggattgacgattttttcatacggcttatgatgtaaatatactttattctgcagctaggctgcagacccgcccgcacgggcatgtgttacggggtgccctttgggtataccttgttccgcagcctttgattgtccaaaatacaaatgaaataaaaggagaaatacctatgatatttgacaaagaatccatacaggatctgctgattggcagccttctgctcggaggcggtggcggcggctgccccaaagagggggaggaacgcgcactatctgcactgaaacttggaaacgtagaattgattaccattgatgaattaaaagagcgaagcagggacggctgtatcgttacgatttccggagttggttctcctgcttcggacactgcatattattcagacgatgtatatcccaggatcctggagctgctgggcacacaatccgaaaccccgattgcaggatttatttcctgtgaactaggggcttcctcctcgtttgagccatttatccccgccgcactctcagggctccccatcattgacgccccctgcgacggccgcgcgcacccgctcggagtcatgggctctcttggcctggagagctccggacagaccgtcatccaggctgctgcaggcggaagaccggaaaataagacatataccgaattaacagtaaaaggttctgtcgaaaatacggcctcactggttagaaatgcggctcatctggcaggaggagcagtcgccgtagcgcgcaaccccgtttccattccctacctggagacccacgccgcagccggcgcgtacgcccaggctttaaagctgggccgcgcgtaccgcaccgcggcttcacccgccctggccattgaagccgccctccgccagttaaacggcagaatcctctgcaccggaatcgtagaagactgtgccctcgaaacccgcaatgccctggattacggaaccttccgtatctccactgcctctattccgtgccagattggtttctgcaacgaatatatgtacgcagccatcggttcggaaaggcttgccgtcttccccgacctcatcacaacaatcgaaaccaacacaggtagaatcatcgcctccgcagacataaaagagggaatggaactgaccgtaatcagcgcgccaagaagtgagctgaaacttggagcgggactgctaaacaaacagaactatcttccattagagggggttttgggggagtgatttttatttagaagggggcgctgtgcggaagtggaagatgcctctcctggatgcattattagggcataagcgccgctaatcaaaatcggaaccggcatggtgaacaccgcggacacttgcgagaattctgatgaattctcactgcgggtctgcttgcttccaggccttgtgggcctggaatcagttcacatgccggttccgattttgatgaagcggcgctaatgccctaaaagacgcatccaggagaggcatcttccacttccgcacagctggtcgcatccaaactgtagtaaaaacactctctaagggggacagcctggcgggggctgcggattggacagaactggtgaaacgttaattgtgccaggagattttgtgtgtatatagaacagttatcataatttaatgttaactatgacaagatgagttttgtattgtagtcaaaatccacacaagactttattactacaccttaatattacgcactgatcagacttacctatctcctggtcacatcataccttcccccccctaccgtgcagcactcccctgccgccggccgcagcacagcctgagggaatcgggatgttttgatgctgtccgcggaggcttatgctgattttggaagcctctagcgggtcgtagaattgcttactgcgaaaaagccgcatcttatggaggataattgatctctaaatcaattatccagagcgtctgagcttagaaagcatcggctttctaagtgaatacgctcggttccataagatgcggctttttcgcagttagcaattctagactaagcggccggtttccaaaatcagcataagcctccgcggacagcatcaaaacatcccgatttcctcaggcggccccccccttaagcctccaccacaaagacatctttgccaagtccgcaccaggggcacacccagtcgtccggcaggtcttcaaatgctgttccaggctcgatcccgctatccgggtctccctcctctggatcatatacatagccgcatggttcacatacatatcttttcatctgaacttcctcctgtccttaacatcatagtatcataatacttctataagtattttcttccagcaccagttttataccccaattcatcaccctttccaaaaacccccgcaaattaaagtaaaatattactattcacagcctatgtgccgtgcatagtaacagtaaaatcttaacatttacatcccatcttccaaatgctatactaatagttatccaaaaaagaaagaggtcaaactatgttccgtctatggggaaaagaaattaaagacaataaaatgctccgcgacaccgtcatctgcgacgagacagatgacacccgcacccacaaaattttcaacgcactcgacgctatctgttacgaattcgatctaagcaagcccatctggctggacaccacaatagccgaattcaaacgccacgccaaagcccgcttctaccaggacaacttcgtagactccatagatttcgactacctcgaaatccaaatcatcgaagaagactaatacatcgaataataagcagcctgctgttatacgctgaggcttgtggagtagtgcttccgaaaattcagctcaacagcaagttaattatttttcgatttactagattctcccctaaagccactccgcttcaaaagaatcccatccgctcctcccgccaggatgcacccagctgtatgccccgccagacaggatacgctgcgggatacggacataagaggttctgtaggctttggagcagctgttagcaggagttaaaggaaaaagaaggaaaaccggggtaaaacttgtaattccgaattacaagttttcctggccccagcgcgtgaagccatcaaggcttcacgtgatgtggccaggttgccccggttttccttcttttttcctttacttctgcttacagccgcctccagtttacagaacctcttatgtccgtatcccgcagcgtatcctgcctggcgggggcatacagcgtccctcctctactcattgcggatagccgccaggggactcagcctcattgctctcagcgccgggaagtaccctgccgccatccccacgaacaccgcgaacaccagagaagccattaccagccacggcggtatataggaaatatttccgtctatacccatggcgcttccattacccgtaaggaagtttataacaaaagacataataaagctgagtatattaccggctacacctccgataaagccgataaatgcagcttccattagaaacatctgcttgatatttttgagtccgcatcccagaacttttataacaccgatttcttttgtcctctcataaatggacatcatcattgtgtttgcaattccgatggcagcgaccaatagggagactgcgccgatacctccaagcactgcctgaaccatagcaaactgttttttcatactttccatatattctgcattcgttgttacctggaatcccatgttcctgattacggatgacaatgcatccacatcgtcgatatcttccgcctgcactgccgcagaggaatacacaaactgcttatacggcttgcccgacttggtacttggctgtccgggtatcacgcgtcccctgaattcacgtttgagcagatcttccagcttattgatatcacagtagacatagtaataattagcattgtaactttccatatctcccgccacaacaccgcttgcctttaccacatgctttttcggaggaagcttggaagtctgtgaaccgcttccatcattttctcccacgcctgatgcgcccatactgttgttctggctctgaaaatatccgtcctgatctaggatcaggaacatctggtcatttgccagatcaacgtccggaacttttcctgtttcccagtaccctttcccggttgacttttcatagaatgaggtcagcacaccatttccaaataccagttccaggctggaactgtttgggtccggaagccttccgcccttagcaagttcgatattctgcttttccagagcttcagggctcattccctttagctgaagataacccatatattttcccttcagcgcaattgcactgagctccagtactggatccgcactctttacatgttccagctgccttagctgttggattacatcgtcagttatatatttattaggttcctcctgatcgccagagctgcccctcatgctgacatacatcccgctttcgctctgttttccggttacagtcaggctcgtcatacctcccgactgctccacctcacggtacatcgactcctgcattccgagcccaagcgatatcataactacaatggatgctgttccgatcacaactcccaggatggtcagaaaagtacgcagttttctgcgcttgaggttaccactactcatcctcagtaaatcgatccacctcatccaccaagtcctcctcttctacagactccttctttttctttcttttcttcatgacgatgataataactatgacagctgcaacaaccactgcagcgattatcacaggtatcagcggaaaccctttctcttccggcatttccgccattgttgttacatccatcggcgcttgttccggggtgatctgcagtgaaaattccttttctactgtagaagcctttcccgcatcatcttcgtaggaaacaatcatcttaaacttctgattacccgctgtttcctgcatggcggtcacgattccgtctattgagccggttgctccggaatctacatttcctacaaatacttcttttgcttcaattccttccccttcaaacttcacttttacattgtacagcttaattcgtcctgtattataaaggctgcacgtaatattagcctcttctccaactgccacggcctccggtgcaatttccagctcactgaattcaaatcttgccgcctgtttcacaggaatagccaggctggaagagccctcatactgtgttgcactgctgtcttcatacttcatagacatggaaatactgtacggcttctgtaccaaatctgccctggcgtttaggtcgatagaaatgtcctgggttcctcctgcaggaatgctgtccagataaatcgtgctggatccggaggaaggcagaaatgccggcgcctctgcggctccttctgtcccggaggacggcgcctgcaggtcaaacagcatattggataccgctgttcttgtagatgtatttttcagatgtacaatcagcttgaaatcgcttccggcattcacagcgcctggctctgtattaaaacctgttacaataacacgcggaacggaattatttccggaaggtgcttcaccaccgcctcccccgcttgtaatcacaggttcattattagaaatgccgccgttgtcctgaggctcctccggggtattcggctcgtccttaggttcttcttttggatcgtctttcgggtcctccgcgggtttcttcttttccagtgtttttacgtaaacatactttgttgtctcatactgctgctttccatcattgcaggttatctgaaacgtaagtttgtaattcttttcaccggcatctgcacgtaccgtcagattatccagctttgtttccacggtctcgcccactgggatatctactggaggaaattcattattcacatttgttatctcaaaaggccatgcagaagcatcatcaataatgggcgctattttaacattcttcgcatccgcggtgccctcattcttaagttgtatcaacagttcctgctttttgtctccttccgtataaaccggggtctcctgtgatttcccaattgacaatactatatctggtatcggtccggtttcatctgctgcccgcaccccaaccggcagtatcatagcagctagcagcgcaagactcattgcgattcctgcagttttcttaaacagtttcatgttccttgtcctccctctttttacggttgtcttctatttttacgatcttcccatcgattatatggaaaattctgtctgcatatgtagccagatggttatcatgcgttaccataaccagcgttttcttctgctccctgactaccctctgcattaaggtcatgacctcttccgacgtatgcgaatccagattgccggttggttcgtcggcaaatataatctttggatccacaaccagcgcgcgggcaacgccaactctctgctgctgccctcctgacatctggttcggcagatgcctcttatgctttttcagattcaccaagtccagcatcttgtcagccttcttcaggcggctcgcccgtccctccccacggaaactcagtggtaatgcaacattctcaagtgcattcatcgttccgatcagatggaatgactggaatatgaatccgacgttttcacgcctgaactttaccaagccgtcctcattcagcgtctccatgtgctgtccgctgattatgacctcacctttggttggcttttccaacccggcaagcatattcagaagagtggatttgcctgagccggaggtccctacaatcgcgcagaattcaccttcatatatctcaaagtccacaccgttgagagcacgtaccacagaatcgcccacgcggtacagtttgtataagtttttaatctcgatgaccttatccacagtgcccctcctttatcccaatattttcaacttacatcatacttatgaaatcaaaatatttctatgtagaatttgttaatattttcttaatattatccacattagatctttttcaataaatgatagattttaatagcattttaaacaaaaccgcgtaagtttttgcgctttcatttgtttagttaatgaaggagctaatctcctcacctttttagctcctttcccaccacatacgttaagcccggatccattaggtatccgggctgtttttttcaataatatttattttttcttttatcttctgatatatctcatcttcatctaagtttattttcccctctgaattgatatactcagaaaagaagtcgggtgtaatcctgaaaaattcgttctgtgattccggtggcagatcggatataaacctgtcgtaaaattcgaaatcatccatcataataaaatcccaaaaccgtttctgctgctcttctgtcatagtgcgtttatccatcttgaccgccccccatccctctcttgtggttttattatattcgtaattgcgaagatattcaagtataagaatttgaattatgcttatcctaaaaaagaggtggtgccatgattgattactctccattctggaaaactctggacaattctaaagaaaattggtatacactgactacaaaataccatttatccagcagcactctataccgtttaaagcacggtcaggacataagcatgaaaacaataaacgacctttgccgaatactcaactgcgatattcaggacatagcaaggtatcttccctcagaaactgatcaggagctctgacaaagtatccgccgatagcgtagtgaagcatccacgccctttccggcggcattcatatgcgtatgagtcccacaaaacaaaaaccacatcagattggatggcattaccggcattcccctgcaattctgccgaattgagcggctcaggccggctaaagctctgctttgataaacagagttcagccttccaattcaatgtggtttttatcttgtaagacttaataagcagcccgaagctggccggggacaggtgcgatccctgcatgcactaatagcctcctgatcccggagtcctccttactctatctgccagtcgacaggttccactccatggctgcgcagaaattcattggtctggctaaaaggccggcttccgaagaatcctctgaacgcagagaggggacttggatgcggcgcctgcaggatcagatgctgcggattattcagcatgatcttcttgcgctgtgctgggcttccccacagtatgaatacgatcggtctgtcctggccgttcagggccatgattgctgcatccgtgaattcctcccatccgataccgcgatgggaatttgcctgatgggcgcgaaccgtaagtacggtattcagcatcaggactccctgctgtgcccactttgtcagacagccatggctggggatagtgcatcccagatcgtcatgcagttcctggtatatgttgaccagggacggcgggacttccacgcctttttttacggaaaagcagaggccgtgggcctgcccgtcattgtggtagggatcctgccccaaaattaccactttgacatccttcagaggagtcagatgaaatgcattaaaaatatcatttgcaggcggaaatatcttccgggttctgtactcctgatttactgtctcaaataattttttatagtaaggttttttgaattcctccgctaaagcttcataccaatcgccatttaatccagacatatttattcactcctaaacttacatttttatctagtataatccacccggttatttcacagagtgaggctgtgtcttaaagccgtactgagacaccctctttctgcaggtattcttttacttcttttatctccagctctttataatggaagagggatgccgccaacgccgcatcggcttttccgaccgtcagagcttccttaaaatgttccagcgtccccgctccaccggaagcgatcacaggaatggatacctgctccgccacggcacgtgtaagctccagatcgtatccagcttttgtaccgtcgcagtccatactggtcagaagaatctcaccggcacccagaccgtctgctttttttgcccactccagagcatccatcccggtgtcaatccggccgccgtttttatagatgttccagccgctgccgtccgcacgccgtttcgcgtcaatcgccacgaccacacactggctgccaaattttatggccgcatcatgtatcagttttggattattgatagcagaagaattgatagagatcttatctgcgccttctctgagcaatgcccgaaaatcgtccacagtacggattcctccgcctacggtgaacgggataaacacgcactgcgccaccttacgtaccatgtccaccacggtttccctcgcgtcagaagaagccgtaatatccaaaaataccagttcatccgcacctgctttatcgtatgcctttgcaatctccaccggatcaccggcatcgcgcagatccacaaagttgacgcccttcactactctgccggcgttgacatccagacagggaataattctttttgtaaacattacacttcctcccggttgagttctacaaagtttttcagtatcctcagacccacttcactgctcttttccggatgaaactggcagccaaatatattgtccttttcaaccgaagcatggatatgggtgctgtattctgtggacgctttcacaatcgactcgtccttcgccttcaaatagtatgaatgtacaaaatagacataagactgttcctctataccgcgaaacagtcttcccccgtgctccaggtgcagagaattccatcccatatgcggtatcttcaggccctcctgatccgggatctttaatatctcgccttccaacaggccaagaccctcggctcccggcgcttcatcacttctctcgaacaaaagctgcagtccgaggcagatccccagaaaaggggttccctttgccgcaacacggcggattacctcatccagaccggcacgcttcagattctccatggcatcgccaaatgcccctacaccgggaagaattaccttttctgcctttagtatccgctccggatcaccggtaacttcgacttcctgtcccagtagcaaaagcgccttctctacacttttgatgtttcccgcatcataatcaatcattgctatcataatatgtaaactcctctactctttccctgactttttgcttttcccggtcttcactacaggcacctgtgttttatccaccgcatccaggttgtttatatactttcttgtctccttcacgattaccggagacagtaaaaggactgcaatcaggttcggtatggccatcagcgcattcagtgtatctgcaatcagccagaccagattcagggatacaaccggcgcgattgccgctacgattatataaaggagccggtaaggaattaatccctttttacctgcaaaatactctacgcagcgctctccgtagtaagcccagcccaggatcgtggaatatgcaaatgaaataatcccgactaccagaataatcggccctacataaggaatctgggcaaacgctttggatgtcagtatcccgccattggctatttcgtttgcattgattgccggattcttcataatcgttgataccagtaccagcccagtcatcagacagactactactgtatcccagaatgtaccggtggaagataccagtgcctggcgcacaggatttctcgtctgagccgccgccgctgcaattggagcggatcccataccagattcattggaaaacaaccctctggccactccatactgcatagcaaggcggattccgccgcccaccagtccgccggcagccgccccgggtgtaaacgcaagtttgcagatggttgttacggccggaatgatatagtcataattaatccccagaataatcagacagccaatcacataaaacaccgccataaaaggaaccagcttttcgcatactctggcaatgctcttaattccgccgaatataacaattgccgtcataaatgcggtaataagcccaataatccatggctggattccaaggttttcctcacagattgcagcgatggcgttcacctgtgtcgcgcatccgatcccaaaggatgcaaaacctgccagaaaagcaaaaattaatcccagccagcgcatgttcagcccacgctccagggcatacattgcgcctccctgcattcttccatcttccgttttaacacggtatttcaccgctatcagggattccccatactttgtggctataccgaacactccggtcagccagcaccagagaactgctcccgggcccccaagcgccacggcagttcccacgccaatgatatttcccgtaccgatggtagaagcaagcgctgtcgtcagcgccccaaactgactgacctcgccttcggcattcgggtcttttgtaaccgataatttaattcctttcgaaattgtctttctttgaataaagcctgtacggatcgttaaaaataaatgcgtaccaaacagcagggcgatcataccccagccccatactttggaattcacatattggaccgcttcgtttactacatcaaacatgattttctcctctctcatcctcccaatgacattccgaaatgaaaaaagaaaacacacccggccgtatgtccccgccggcgggaccgctgtaaacagcggtatctgtaaagagtaaggcatacataataccgaccgttgccagttggcacaatgtatgccttaatagtagctattttacagcattttacatcgcttttcaagtttttcagctatggagcccgattaaataccgtctatgtgttactattcacggcccaggggccgcacatagtaacggcatctgcccatttaagccgcctacggcgaggggtgctatgcgccagtggcgcatgttaagcacggaccgaagcggagcaaagactagatgccccgagaccatcacttcatcagctccggaaccggaggttttgccccctctgcgcattccatatccagctcaaaccagaattcgacgccattttcaaaattatttacgccgtagtcctggtggaaggactccattatagcttttacgatagacaggccgattccattcccgccgtattcccgggtatgagccttgtccactttataaaacttatcccacagcttatgcagatcttcttccggtatggggttaccgctgttgaatacagatactcttaccgttcctcccctggatattacccggatttcgatacgcttttcgttttccacatgatggatcgcattggtcaaataatttctgactacctgttctgtcttgaattcatctgcccagacatataccttctcatccgctataaagtctacggaagcctcgacctgctgaatcagtatctcgcagcttgaaagtactccctgtatcagcccgacaatatcaaaacgttcgaattccagttcctgagagccgaattccagttggttcagaatcagaagatttttcaccatctggttcatcttcgcggcttcatccatgatgacatcacagtagaactcccggctttccggatcttcgttgaccccttctttcagcccttccgcatatccctggatcagcgcgatcggtgtcttcagctcatgggaaacatttcccaggaactcattgcgcatgtcctccagtctgtccttctgctctatgtccttctgcagctgattattggcactcttcagttctgatatcgtcttctccagacgggaggacataatattaaaattcctgcccagcacaccaatctcattatcaccgccgcttgtatattttgcctcaaaatccagcctcgccatgcgctgggacagtactgccagctctttgatcggctccgtaatcttccgggagaaaaagcatacgagaattccgcccagtataactgcaatcactcccatatacaccagaaacttattggccaggctggcgctctctctgatactctccaaaggactctgcataataaaaagagagccatctgaaaattcgccccaaatttcaagatattccgtctgattcgtaaaatccttcgtcttgcagatctgatagtaatccgtatttttcaaaaccttttttgagttctggtttttatcgaacaagtaggacagcagcttgatatagagagggccgtttccgtcccacacggtagaaaatacaactgtcccgtcgttttgtataacaagcgccgcgatattggtccgctctgtctgacgtacaagtttttcattcaccgactttgatttaatctccccgctgcggatttccttgtcaatggaattataaacacttaacagatctgcctgcttgtgcaccgtgtaatactgtgccaggaatcctgaattcactgcaaagagcaggataagtataaatataatcaacccgacaaagataaccatcatctgccgtcttattgattgtttcatccttctacctcgaacttatatcccatgccccagatagtcttaatgtagtcgcccttctcccccagcttgctcctcagcttcttcacatgggtatctatggtgcgcgcatctccaaaataatcgtaattccacacattattcagtatcttctctcttgacagggcaatcccctgattctccacaaaataggacaaaagttcaaactctttgtagcttaaatctatggttttgtccccgatctttacaatatgcgcaaccctgtcaatcacgatcccgccggcatccatgacatcaccggagtctgtgctctgtgttcttcggaggatggcttctaccctggccaccaggatcttggggctgaatggtttggatatatattcgtccactcccagatcaaacccctggagttcgtcacgctcatccgagcgggccgtcagcatgatgatcggaaccttggaatgctcccggatctcccggcatacctgccatccatccatcttcggcatcatgacatccagaatcaccagcgagatatccttatcttcataaaataaatccatggcctccatgccgtcgcctgcctcaagtaccatatatccttctctcgtcaggaaatccttcacaagcttgcgcatcctgctttcatcatccacaactaaaactttgattttctccattttaatcgtctcctatctgttctttttcctgttttttcccgttcttattcctttttgtatcataacaggtaaatttgatggaactgtgaatttacgggattttcgggcacttttccccggtatccgcttttattccacactcttcagcgattccaccatatcgatccgtttcagtttgaaatacattactccgtttacaaagagagagaatcccatggtaatcagaaaactgtatacaaagctgctaaagtcaatatttcttccgaacatggcagaatcaatctccacagtcacaatgacaaactgatgcagtatccttccaagcaatatgcccactgcggagccgactatcgtcaggattatattttcacggtaaacataagccgatacctcgttgtcaaagaacccgagaactttcagcgtagccagttcccgcttccgttctgtaatattgatattattcagattatacagaaccacaaaggccagcattcccgcagatataacaagcactaccaggacaatatccaggctgcccagcatgtcatccagctgctgctgcatattgttcgtataactgatgctcagagcgccttttgtctccagaatggactccccaactttttcaagttcatccatcctgccctctttcatcgtgtaatagatggagttatactccggagcatctccatacagttgtttgtaaaggtccggtgtcaaataaatataatgtccgatatagttttcacatatctgcgcgattttaacctgaagttcacccttcacatcgtcttttatgctgaccgtatcacccacgcctgcatccagcatctttgccgttttttcggatataatcgccccggtattgtccagcttatagtgttcatcggtaatccggtttttaaaaataacaaatttggagaactcatccaaatccttcggcacattcaaataaacatctcttgttgtctttccatgtgtgacctcgacctgctgaaggaagttctctgcagtgtcatccacccgtttatcggatgccagtttatcatacgtttcttctttttcttccgcagaagcgtcctcttctaatataacatttccatcgtaaagctggatctctccatactggagcaccgcaatgtcaaagattgaatccttcagcccaaatccgaccagaagcagagccatacagcctccgattccgaatacggtcatgaaaaaccgtttcttatatctgatcagattccgcacagtcgccttccagataaagcttagccgtttccacaaaaacggaatcctctccataaacacccgcttcccctgctttggtgtgggcgggcgcatcagctccgccgcctgttcccttaactcatgaaaacaggagaaaatcgtggcaagcagtgtgcatgccagggccgcaagtgatgccgccagcccgtaatacatgttgtatggggtcagtacggtatcaatatgctgatacataattccataggctgtaatgataatataaggcagtattttctctccgaccagtattccaaatgcactgccgctcacggttgcaagacatgcatatccgatatacttgcccgcaatggagtgtctttcatagccgagcgcctttaatgttccgatctgggttctctgctcttccaccatacgcgtcatggtagtcaggctgatcagtgccgccacaaggaagaacagcaccggaaacacctccccgatggccttcatacggtctgcattttccccgtagcttgtatattcggtcagagtgcttctgtcataaatataccacttggcatgctcaatcttgctgatatccttctcggcatccttgattttcttctcgccgtcttttatcttcgtgtctgcttcagattttgcatcatcgtactctgcctgtgcatcgttcagttcctgctcttttgatgcaagttcgctctctcctgccgcaaggtcagactgtgcctgttctatctgtgcccagccgtcattgatctgctgctggccggaatccagctgccccctcgcctcgtcgagttgggcgcgggccgcctcaatctgtgcatccccttccgtaatctgggcgtacatcacctgcagagtattttgggtctgctcgtcggtcagcccgcttgatgcaagtgcgtcatactgggccttcacctggttcagttcctctaccttgccattcagcacttcgacctgagcgttcaggtcctcgtaaccctggttgacctcatcttgtttctggatcagctgggtgcgtgaatcctccagctgtgcatagccgttggatatctctgcctttgcattctccagctggtttctgccgtcatccagctttgcttttgcatcgtttaacttatgatctgcctcggttttcgcatcttccagctctttttttgcatcgtccagcttatcctcagcctcatctacaatctcctgataccgggcgtcctctctcgttttacggatcttctccacttcatctataacagtgtctatatggtcatcatattcatccgtgaacgcagtcagctcttttgccccgtccacagcagcatacatctcggtatacacatccaggtcaaagctgtccggtaaaacgctgacaaacccgctgacagaaccggtgccgatcgtgctgctgccgcgatggaaagagatatagcacgggctgctgaccgttcccacaatggtgtaagtatccgtcttcagtgtatcggtgatcttatcctctgtccccgataaaaacgtaatcttatcgccgacctcatatccgctccccgtcagaaaatctacatctgcaacacactcgtccgatgcttctggcagccgcccttcttccactaccagtttattcatggacggaagcagcgaagatatatgtaccacctttttgctgtcatttacagagcaaagagcatctgtcgagtagcctgcttccacgtactcaataccgtccaccttctccaacgctttcaggtcatcttccgttagcccaagggtgctgatcaccttaatatccatcaggttctgtctgtcaaaatatgcgtcccctgaaagacgcatatccggttccgcagagcggatgcccgagaaaaacgcaaccccgattgccacaatgaagaatatcgatagaaaccggcccaggcttctgcggatctccatgtaaaaatcttttctaagtgctttcctgctcatatgcatgccctaccattctatttggtcaattgataccggattcggattctgctccatgccggatacttttccgttcttaatgcggatcagccggtctgccatcggcgccagcgctgaattatgtgtgatgacgatgaccgtcatgcctctctccctgcacatgtcctggagcagttttaagattgatttgcccgtattatagtccagagcaccggttggctcatcgcacagcagaagctttggattcttggccagggccctggcgatggatacacgctgctgctctcccccagacagctgtgccgggaaattgtccagccggtctcccagcccaacttcctccaacacctccctggcatccagaggatttttgcagatctgaagcgcaagctctacattctccaacgccgtcagattgggaaccagattatagaactgaaacacgaatccaatatcattgcggcggtagctggtcagctgccttgcattacagctcgtgatatccgctccgtccaccgtgatctttcctcctgtggcagtgtccataccacccaggatattcagtaccgttgtcttaccggcgccgctggggcccacgataatgacaaattctcccttctcaatcgcaaaatctattccgtccaccgcacggatctcaacttctcccatcttataaatcttagtaatattctctaattttacaaaatccttcatcttagcatctcctcgtcagctgcatattcctgatgcggctgtgtggccgcactcacaccccggagacaggtaatcccgcattcaggcctgcccagtctgtttaacattatatcacgttcatatgagaaaatgatggaattcttactaatttcacaattaatttattgctaagattttatggtaaaagcaacgggctgcctgtcataatcaggcagcccgctgctttttcggatatctattttacagcttttgcagctttcacggcctttctgaaaaggatgaatcccacaaggaaaaaaacagacagcgcgctgactcctatatttacattgccggtaatctgactcaacacggatacgaatgccgtgccgaagatggaggcgccctttccacagatatcataaattccgaaatattcaccggacttttctgccgggataatcttagcgaaataagatcgtgaaagcgcctggatcgtaccctggaacattcccaccagaaccgccagtatccagaaatcaagctgagtatctaaaccgtatgcatacagcgctatacaaaaataggcggcaatacatatcgtaataattgttgtggaagccagcttttttgacagcctgctgaagataagaacgcagggaaatgcgacgatctgtgtcagcagcagcgcaagcagcaatcccgtactatccagaccgagtgcctgcccgtaggcagtggccatatcaatgactgtatacactccatctatatagaagaaaaaggccagcaaaaagaacaggacatgcttttccctggcaatttctttaaaagtgccgccaaggcgtctgaaactgttccggaccacatgctgcgtcgtctccacaaaatacttctgcttataggaacgcaggagcggtactgccgacagcagccaccagacagatgtaatcagaaatgcgattaccatggatgtctgcatgccaatccccagttttccaccgcccagcactactcccaggctggcgacaaaaggaatacagcttccgatatagccccaggcaaacccctgggaagatacgacatccatcctttcaggttcggtaacgtccgtcagcatggcatcatagaagatcaggctggaagaatatcccgtttttgtcagcacaaatactcccagaaaccaaatccaggaagacaaaaagcccaggacgatacagccgatcacgcccactccaaggaatactgagaatatcactttcttataattcttcgtatccgcaaccgcccccagtgtcggcccaagaactgctacaaacagggtgcagatggaggttgcatatccccagtacgccagataattgacagaagatattcccgcaatatctgccagatggttgaagtagattggaaatatggtggctaccagcatggtaaatgcggagttgcccacatcatataaaacccatttcttctccaaggctgtcattttaaatttcatagatttcccccttttattactttctctcactcatatttataactgctcattccgtgtatatccgtttgcccctgatcctacagcggcagttccttccagtcttcacctgcgccgaatgtctcatggaatcttaccggaagctccgcatcctggaacaggactttttggaacttaatgatcaagtctgcagccagcggcacagctcccgcatatagttttttcagcagcagacaataattttcacactgcggatttgcctcctcactcataaccattccgtgcatagaatcgtattttcccattaccttcatagcaccaaaaaccagttttctctttttctgtccgggcgcaagcaggagcttatggtaagtaatcatggagctcagcgccttttttacggtatcagcagacagatcctcaaaaaatggcgcgattacctttgcattttccatcgtagggtgaatgtgttttgcagaaaaatacgtcaccggattaatatggtctccggtcaggagataccggtcaaattccatctcgatctcggaatggctgatcccgctgacctgtatcatcttttcaatgtacttatggcactcactgtccagtgcaaaatggcagataaacccatacatataagccctggccgccgcactgtcatcggtttttgagataatctcagcggcatggctgaaaaactgatccgccatcttatcatgcagcgcgtatccctgcccgctcaccggattggacttcaaggctttgtaataaaacaaaatatccggtccgtgaaggccgatatcaaataattccctgttgttctccaccgctttttcaagcggcctgggaagggcactaataacatcctttccaaatctatagtgtgcatacgttgttggcatagcaaaaacctcttttcctattaatttttatgtattccccctccggcaaaaacattccacatcccgcgcgcggcgaagaccggtgcacttcaggcttttaccattcgtctaatctcccggtaaatataaatagtcctgctttataacgtccgcagaatatcaattatggaatgcccttggatatatattatcacagaaatcggggaaagaaaccagtatatcatagaaaaatttatgtaaaatttcaatagcagcgtatttcctgtatgattaggcggcatttacattcttttccatatactgaatactacagaaataacctaccgtgcaaaataaggggtatatgaaatgagacctaaaacaaaaccgcatagtgtattaaattattttgatactggaaccgtatcccattgcttttgtacacctaccggggacataaaaataccaccaattctatatccatacgctgcccccgtttaaggttcctccttagaaacgagcctttacctgccggttggatgcgccagctccatgaagggatagctgaaagcctcccggagaacatccatgtcctttcaaaaacgctcaaagcggaccttagaaattcttggtgggaaacagcccggaaaatggagagatttttggattccgaatccaaaaatcagctgacccagcgcgagaaatcatcggatttctcgtgatgtgtcagtggtgctccattttcagggctgtttcccgcctagaatttcttaggcccgtggccgcgtttttgaaaggacatggatgttctccgggaggttttcggctatccctttatggagcgtctccatacgcgccgagactaaagcccgtcgctaaatcccgatttgaaaaaaatgtaaacttttctgaatgccttgactttgaagcttcttttttatagaatagatatgcggcagaatatacatgaactttcttttctgcccacatctaatacaggggcttgtactggtttcgacagggatcttgaagatggagaagctatccgcaggcagatgcgtcaaatcgcaaacttaaaattaaacgctaacgataatttcgaattagctgcagcctaaatgctgcatgtcagccccggggcacccgcaccctgggaatctggcaccgactatgtgggaaacgatatcagcaaagctttgagctgttaggcgtatcatgaagctactgaaaccgtaagggtgttagttcccgtacggcagagggaatgaaaaagaactgactatgatagtagaagtacatgggataggtttttggacgcgggttcgattcccgccaggtccactattatggggaacagcgaatattcgtctgttccccatttatttaccgttccaacctccccgttaatctcatcgaattgtgtgaaattaaagagtgtaattctacattagtacctcaatagactttacactcttttttgtggattagtattttttatagatatctcctctattgtcgatgttttcaatgttaatgatttttacttctttgttgatagaataaatcacacgtacatttcctatccgcatacgatataggtcatatccttttaattttttgatgtctgtgccatccggcaatatcgataccgctttaaacttcacggcagatttttcaaaagtgattttatattcactcatacgcctaattcctgtttcacgtcaccaagcgtaaatgtctgaccgtcattttctctttcggcttgtgcgatcatttgcaagtcccattcgtccggctctatctcttcgccggcatatgcttttaatgactcaagcatatcaacgataaaaacaagcctattgtctggtacatcattgattaattgtataatcctgtctttgttgctcatgctatcacatccttttttgatacatatttattactatatgtattatatcatatgtgaaagtgtaaagtctattcgattatcagtgtaccttatcaataatcaaatacaaacgtcaggtttcttaatatctcatcccccaccccttcctcatatcatccatcatcctcaaaacatccaccgtctcttcatggggcaattccggacattctttccacccgttttggattgccctgcagcagctttccacttcatattccagtcccgtaatctgcacaggcgggagcttctgccctatcaaccggtctctctggtcatacgccactaccttctcagggttattgacatttgttatttccatatatcccttttctccgaactgcacacccttccggttaaacacggaaccaatgccgctgtgaagcacagccatttttccgccctcaaattccaaagtaatgctgtccgacatgtcaactcccttctcatgtaagacgcatgacgcttgaaccttttcgattttagtgccaaatatcatccttgcaaaatgaatcagatagatccccagatccaagagtgcgcccccggcaagccggggatctgtcagcctttggactcccagcagcggatagcctaaattggccgtcagtgattggatttctccaatggttccctcaccaatcatgctctctatcatttttcttgaaggcatgtatcttgtccacattgcttctgtaacaaagcagccctttttatcagccatttcaaacacttcctctgcctgcaccgcatttaccgtaaatggtttttcacacaacacatgttttccatgttccagacatagttttgtatgctcataatgaagtgtatgcggcgtagcaatatagattagatcgatggccggatcatttaccatactttcatacccgtcataggctttttcaatcttgtattcctgcgcaaatttatgcgcgcgcccttcttctctggatgcagctccataaacgcatgccgaatccatctccgatattgttgcagccatcttccgggcaatggaacctgttcctaaaatgccgatctttaacatgccttcccctttcttttatctgacaaactctctcaaaataaatacggcagaaagtgatatagataatggtacactgcctcataggcatgcacctccccctccgccagcagatagtgaaaattccccttatgcaggttttcatgctccacaaaagtatccggatatttcctcatggcgtttacctggttattcagtgcttcatatgcgatatcttttgttcctgtcgcggtatatatgaagtattcatcggcgccatatcccgaccggacggcatgtttatgcagtaaggctgctgtttcctccggtttcgtcaaaccaccctgcccctcaacttcccagcaatccccgctaagaggcacatagtaggcaaaataatccatattcctggtaaacgcataccatgttgtcgcagcgcccatcgaaaacccacagaatccccggtgcattctggaagcccggaaggcctctttggtgatgtcgtcggcataggtgttgcatgccccttcaaccgccggcagcaaatcctctattaattccgtctggaagaattggacgtgaccgcgttccacctcccgcaccggctctcctatccggcctgttttttccttataaaatgatggaaaaacgacgataagaggatcgattttctttgaatcaatcacgtaatccagcatattttttatcttgcagcagtccagccatgcatcgggattacctcccccgccgtgcatcacatagaggatattgtactttttgctccaatccatttcatcatagccatagggcagatacatattcgcatatttttcccttgattccccctcttgattcgtagtcagatactcgatcctttttatggtccctctccggtttacatcatggtatgtatacttctccattacactcccgcctctctattcttccagaatttccccagttggggccgttccttttatttcgtaggacatgtcccacagatccgcctttaacaccgcagtatagcccgctttcttccactcaaatgtcatgcggctcccctgtacgtcaacagatatctcggaatcaaaggaaaaagccggaaaacatgttctgaagcgcagcatatcaagctgtttcctgacgacttccttgcacagcgcctgctccatctgtacggttgataaattggttctgttaatttccttatgaccggccgcaccggctttcttcactgcctcatggtcgttcttccctgcaaacaggtcaaggtaccaaatctgcggcttaccgggcataaacagctgcagcgcgcgggccatgagcattttcctgtcgttttcccctaatgcgctgtaataggtggaatttacctgataatatatgtttttctgcccatgaaggtcttttaccataccgcctctagcaactacaacgtcaatcagcttttggatgcgctcttccggaatcagcccttttagatccagcagcggtattccatcatggcatccaagcatatttactgtttttattttcttttgagtgatctcatccgcccatgttttcaaggccgtgccgtccgcattctccaaggcgtcgatgatcaggcccggaagaaagaaatcataggtcaaatacccctttgaggatatcacttcataattcttttccccatagcttgcatgaatctcaggcaaaagtgacaggccatgtttatctgccaattcctgcaccttttctaaaacgtcccatgtgccgggttcgtttaagaagtttttctcccccggttcctttggggcgtaggcaaacgcatcaagccttatgatttttgcaccgtatccggaaagcttttttaaaaccgcatcgtaaaaatcccataccagcggtgacttaatatttaagtccatctggcccagatattttctattggattccaggtactccacaaccgcctccttatatggggcgtactttccaaattcaatttctccgggtttctttcccgtctcaagcccttcctgaaccatatgcgcgatttcatctgccgcataatactgcgtgccggccgccctcatgacatcctgcgcatctaaagcaggatacctgacctcctgataaaaagtgttccaataagggacattttttccatccggaaaacgaaccatcagaatcggaaggcccggctttctaaaaaacatattcttaatgtactcgtcctttggctggatataaccttccggcgtcatctctccatacccatcccaaaactggttccagtcaatgaagaaatcccggtagcctgaattctctccgtttttaagaatatcctgaaattgttctgaaagtacggaggcatggttgagaataaaatccagtttcaggtctacgcccaactgaccaagctcttcgagatcctcacgttttgcgagctgatcattcaggtcgtaactaatcacagaaaatcccctgtccaggtccgtatgaaacagacttggaagaatataaaaggaacgaaatgtatcttcaaattccggttttcttaaaataccgatgatatctgccagcgtcccgcccatgctgtccggataagcattcagcatgggggcgttatttgtacttattttcttcatctttctcctgccctcaattcttcataggttatcagacttccgggtttagaaatgataattttcgccttatgcgcctgtgcgcccagcatctgctgctcaatttccaaaacccgcattgtaaacggactgtcggtcttaccgtccctgtttctgctgcgcctgtgggcgagcgtctcttccggcgtactgtttaatagaacaggaatatcaacgccctcataatagtcactgtttccgtgggtccattcaattactaagacatggatagctctgaaatcaactttttcataccataagtcgcactctgttctccccattctcttcagccagatattttctgcacccattttaaacaaccttacaatctccgatatctcgtcaaaatcaatctcattctttgttccaagataccctttcaatcccaaaactgctccgtccagatacgtcttgaaccaagggtactgatcgagatattcctgattcgcatcatcgtctttttcctgaagactacgaagcacagaatatacctcctcatccagcatatctgcactggccagtgcctttacacccgactgtctgaatatacggagccgctccgcgtcgttatatttggggatgcgcctcggataattatctccggaaagcgtataactgccaatccccagctggttcaaataccaggaaagcagcgatgcaatctctgatttaccaaccccggaaccaccgcagactgagataaccgccttaccacttttactgctttttatgacatccggaagtattttcagcagttctgcaaaaataacttttgacttgctgatatggtccggtccgatgcatacctgatctccgggcatgtctccgtgtggaatgtccgtccctgcctctggaaggttcccattttctgcattcttcaaaatctctaaaatatgatccataatatcctccctacaactattttgtttacccgctgatataattaagaactatatagtttcctattcaaatttcctgaaaaccataacaagcagatggctttttatgctcagtaccaatgcccctgctatgagccaaataaaaaccgcatacagataccatataaagcacgcgcagaccactgcgatattgcacagcagaagaagcaggctgacgccaaacttcccggtcccgatcatcagggcacactttaagacatgcagtgtgccggcgttaaaccgggccagcaatgcaaaggaatactcacctatgattgcagccataagcgtaacaaccacaatgaccgacaacagtacataggagagcagtcccaggttcagatgccagacgatataccagtcaaccgctaaaacagccgccgcagtcagcattatgagttccagcagaattccctgtttcagattctccttaaatgatttcacaaaagactgcatcacattcggcgattcctttctggctatcttcatggcagtataatgcttcgctgtcaacgccgggccgatcgtaataatcgggattgaaaaaacgagcgtaaataaaagtaactgcagataatcaaaaaatgtatccaacagctgcattgccttattctccgtactaaaaaatcccatatccttctcctttaagccgctctacatttccaccggcggaatcagtttggcagtctgtcccgccggaacttcgatatactcttttgtaaatgtcccgcccaggctgacacagactgcagaaggattatataccgtctttccatccactgaaaaaaccagccttcggtatgcctgtacatattccctgatctcgccgtttgacgcataccacacgtcttcgtgcccggccatattttctataaagttttccatatgcccccagttatcgttctggtcgaattcatagctgtgtccccacacataaaacagctttgctggagtcagaaggttaaagtacattctatcggataaaaactcctctgccagatcccatattttttcatcgtcgtgatggcaggtcggattccaggtaagaaaattctcaggaatatcaaatctatgagtggaatcaatcgtccgtgcatatgtaattcccgaagcttcgacagcctttatcaccatttcatcataagcgccgaatgcataggcataaccggtcactgtattcttattcaggatctcaagttcttttctgctttccagtatttcttccacgcaccttgcagtatccatgcctgtcaggcactcatgatactggccatgggccgctgtctcatgccccttatagagtactgccgcttcctgcgcgtccaccttcacatggggcacttctttttttcctgcggcaactgtgccgtttctcccaaacaggcctggattcagattaaacgttgcctttacatgatgttgattgaacaattcaaccagtcttctgtcctgtgtgattccgtcgtcgtagctcagtgtgaacgcctttctttttccctgcgggaataacattctgtcatttacttgtaaactcatctccgctctcctttcctcaggctgtccggtttaatgtaactgttcaggcttgtctgaactgttacggtttattccttcagcaggtctctgatcagccttgccatatttaccgatagcagcgcgtaatggtctgtcgcatacatcacctggctgcataccgaaacgtgccggttgaggatatctttccagaaccattccgccgaaatatacagcatgccgtacctttcaatgggctcacacagcatagcgcgtacccggttatcaaccgtacagcccatgcagcccctggcgatctggatgatcctgccgtcttttaatgccatttccgcccggccgttttcttctacataagaagcccccataatatctgcaataaatgatgcaggaatcatgcagtattctccccttacttttgcctgtccctgcaacccgtggtatttcagtttttgccacatcacagactttgcgggcatttttatctttttcccatgaacccaggcgtatgcacagtccggtgcggctgcaaagcaataccggtctccctctctcttacagattgattccatatattcggttgttccgtctgcttttctttttgagccggaaaagagatagtcccatacaagctcagcctcgtcaaaggtctgtccgtgatcccggttcttcacgtcgcggaagacataatccgccttcttccccctgtaaaaagcaaaattgttttccccttctatttttagctccggcaattccacgcattcattgattctcagccagtattctctgtttttagccaccacgtcttccaccgtgtcagtgctgcccggcggcgactggtcgaattccattctggcctgccagactgtgagcggaccggcatcgttcaccgggttgtcgtgttcatcaaacaaaaggccaatggtgcttggccccgcagaacccgccattgccgcaaagtgatccccataatgtcttgccatcatcgccgtcattgcatttccaagggacatgccctgcatatagatccgttcttcatcaatattgtatttctttttcatgatctccagcagctcaaagaccatcctgacatcattattttggctgatgtcatccggaaaatcatgcatatagatcccttcctcattcggcgcggacagctcttcaaataatcttctttcacactcaatctgccagaatctgcgccggtgcgcatttgggtaaaccacaataaatccctctctgtccgccacaagcgaccatgaagtatagatgcactgtgcccaccccgtcataatcccgccgtgcatggaaaaaaccaggggcgtcttcctggaaggatcataactgtccggtacatattcataccaggtatcctcctcatcgtcgatcaggcaggccttcatttccttaagatttgccggatagacctgggagttgttcccattctcattgacaacaatttcgctctccttcaaacgttccggcagatactcacgattgtcgtcatccgggattcctgccagaagctttatttttgtcgtttcactcatgctttatctttttcctttctcttttttctgcataccttgattttcagctttcgctggaaacacgcccatagggcatgagttacgagatgcccttttgggtgtagattggcattttccgaagcggcagccattcgtccagagcttttttcagatatggatcccagaaattccagtcatgggtatagccaggcgcctcctcataatggaagctgacgcccagtttagccagggcatttctgtcacgtctcacaacgtcccggataaagtcattttcccctacagcgataaatatttccggcagcgctgtcccttttgcaaggtgcctttttacatatccgcccagatcatactcactgtctcttaaccggtccggatctccgaatgtggcctgcattctccgcatttccaacgtccgcacctgttcaataaatgcatccgtatccacgctgcatccaatcccgcccgacagatccacgcaggcctggtacaaatccggccgttttaacccaagcgccagggaaccgttcccgcccatggccagccccactacgaagttatcttcccgttttggagaggatggaaacatcgtctggatgaccttgggaagttcctctgtcataaaagtaaaatatttatagccatactgtgtatccataaaaaaactgtcatttacctgcgccgttaccgtcatcacacagttttcttgtgcatatctttctatattcgatttccgtaccacacaggtatcatcgtctccgcccccgtggagcaggtatacagtctgcagtttcatgccctcccggtattcccactgccgcctggcagccacaccttcttcccgcttcggttccgtgagcgggtaataggtcatatcttccgatggaaatgtgaccgtaacatttgtgtgcaggcttaatatctctgatcgaaagctaaatctcaataatcccataatctctccttccctttttacctggcgctgatatttttaatccattttcctccgcgcagcctgtaaaaacataatacgcattttaatatttcatcaatcctcagcgcacaataggtccagaatgcaggcgctttgaacataactccaacgacatagcccagaggcacgctggccgcccataagaaaataatgtctgccaccatgaggaatcttgtgtccccgccgcctcttaagaccccttttgtaagaatactgtttatggatctgaagaagacaataaacgcaatcgcccacattaactgacgggctatcatttctgttgcctttgtaatgttatagcaggaaataatcggcccggagacaagcagtatcacgactcctgccgccactcccactacaatgccgagcccgacaaatgcatcggcctcttccccggccctttttgcatctccactgcccagtgtatgccctactacaatgctgctggactgtgccactccctgtgtcaggacgctgctcatctgctggatcaccgccgtgatggagaatgccgctacaaactgggatccgatgcgcccggtaatcatcgctattacgttattgccaaatccctgtaatgtatcactgatcatgacaggaagcgcaactttcatgaattctttatttaaatgtttacttttaagcagaatatcttttactttgtattggattgccttgtcagccagcagaaggtacccgaaggtaatcccaaattccagtattctggcaagcagtgttcccaaagcggctcccacaacccccattgccggaaatcccagtttgccgaaaatgaagatataattaaaaccaacatttgcaaaaaatgccaggacggccgtatacagtgggatcttcacctgtcccacgcttcgcagtatgttagagccgatcagcgaaagcccgcagaataggtagcagtatgccgaatacccaaaatatcttatgccttctgatattacatctgcatccgctatatacgtgcgcataatcgcacccgggaaaaacaaggtcgcaaaagtaaagagcaaagatataactacagcaaactttagtgcaatagatatcgtcgttttcaacgcatttctatcctgcatcccccagaatcttgcggcaaggatagacgctccctgcccgagccccatgcatgcaaatgtgaagatattgataaactggttcgcgagggataccgccgacagcgcattttcccccagggtgcctaccataatattgtccatcatattcacgccgatcgtgatcaggcactgcagggtaatgggcaccgcaagctttactgttttacggtagaaactcttatccgatgtaaacagtttcatagctctacaccccgggcttcccctttgtataccagccaattgtcttcctgatttaaccggtttttcatggcggtaattttcaccgttccgttttgtttttcaaacctcatgatggtcagcgcccaactgctcatccaatgtatggtgatctccagggtatatccgttgatgtaccgcgctgtagcgctgtatgccgtaagatccgggaatacattgtctgtgttcctcagtacaagcttcccgtcaaaacccgcctcaaacctggcataaccgttcacttccaatatacagcggtcctctttcatttccagcctgaattcttccatcctgccttttctgtcttttgccctgtataaagcaaacatgtcagcacctcccggaggcgcaagccccagccagggtgttgggtccccttctgtcactatatacttaccgctcaaatcaaggtccggggttatgtcattcggtctgtccggcataaactccatatgtttttcgatttccaataaccggttatattcctcttcattttcttctaaaggctcttctgcgatcttcagcagcagttcttcgtaaatcacatccaatgtgcgctgcggcccgtatggcgctatggctccctcatggactgccactgcgacccgcttcttaggccacacgattccatattgcccctgtgctccatcaaacctgtacacgccgggtatgctgcaggcccaaagctgatagccgtatccgcatcttccgtctttttgttccggtgcgtattcattcccaatctgaacggatagggcctcttttatgtaatcggggtcgaccagctgcctgccgttccagctgcctccgttcatgtacagaagcgccagccttaagttgtcttccgttgtggaaaatgtagccggttcggcatccaggccgttaggccacttcaaccacacgaaccgttccccgttgattccgatttcatcaaacagtcttggggtaaggtattcctttaaattctgccccgttttcttttttatcactgcagataacatgcaggcgccggacgtgttatacataaatcttgtccccggcttatatttcataggagtccgaaaatagtccccgatccagtcttcccctatttccggatggcgtgcatgtccgttggtcatggtaaggacatccctgattctgatctctttcattaattctgaaacttcaatatttctctcttttatttcttctgcaaagatatctgtcattttttcttctaacgacagcttgtgttccataagcgcaattccgaccgccgttcccgtataggttttcccaagagagttattgccgtggaccaggtctttgctatatggcgaccaaaaacattctgcaaatacttgcccattcctggcagccataaatccatgcatacttgcccattcattcgtgagcttttccaggcaccgccttacctgactgctttcaatccctgctctttccggcgatattctttccaattcatcatgattcggcataattttctcctttctttgccctttgattcatacgtggtgacgttttccttaccgtaaacaggaaaaatacaagcgctcccagcagcaagatgccgcagatatcaaatatagctgtaaatcccgctgtccctgcaaacatctgaacaacacatccgccaatcatcggaccaacaccctgacagatatctccgcccagataatatgtactcgtggcaaccccgcttttttcggtccctaccgtatgaatgcagcctgcctggagagacggctgtgccgcaccctgtcccagtgacctgacggccccggccaccaaaatcagcagcagcgtcctgcttcttcccagcataaacatagccgatgccgtaagcagcaggcccggcagaactgtaatggcaatcccctttttatccatcagtttgcctgagaacggccggatgataaacaggacaattgcacacaccgtaaaatagatactgattcccttcactccgatctcatccgcatataagactaaatacgatgcaacgatcccgtttgtaaacgaaaatgtacccgcaaccagtgtaaatggaagcgcctttaccgcaataatatcactgaacccgatttttttcttttccgctgcaggcttcttctcttcatggaaaaagcataagatgacatacgctatgacggtcaatattgcggaaaccaaaaatgttgctttcattccaacaatatccgctatcgtaattccgattcccggagccactgcagagccgaccaccatgcccagtcccagatagccgatcccttcccccattttggtcttgggaatataacgggaggccagagaaatctggcaggttcctgataacgcgaagccgattccattgataatccggaatccgactaaaaggggaatctgagttgtcagcgtaaagccgagcagtccaatccccatgagcacattgctccattttaaaagcgtcacattgctcaaccgatccgccatgattccgctgaagggccggcaacacagtgaagtcagagaaaacagtcccacgataaaccctgcgatggccaccgtagtccctatattcacaagatacttggacagaattgtggctgtcatataaaatgagaaagcgttcaatgtattgacaagaagtaccgagatataatgtttattccacaatctttcattcattattttatttcctttatattgttaattatggagtttcgcttgcgaaactcgcgcctgcggcggccgcatcgcggcatctacctttacgccgcagtgcgcatcccccggagggccttttatcttatagacgaattattctataagataaaatggagtttcgcttgcgaaactcgcgcctgcggcggccgcatcgcggcatccaccttttacgccgcagtgcgcatcccccgaagggccttttatcttatagacgaattattctataagataaaatggagtttcgcttgcgaaactcgcgcctgcggcggccgcatcgcggcatctaccttttacgccgcagtgcgcatcccgccgggagggcttattgtttagcacgcaagcgaggaacgcttgcctgttaaacaataagagagggcgttgccctctctttcgtaattacaacggctggcttattgttctgcgagccatgcatcaagctgcgcctgtttctctgcgatgatctcatcaattccggcatttttaaggtctgcctggaatttcggaagtgtggattcaatatccacctcaccgtacatcagcggcgtatagtactgcgccacaacatttgcacaggccgtcatctgatccgcaacctttgtggaatcaaacgtaaatcctaatgccagagacttatcacaggttttattcttttccagcatctgatcgtaaatatcttccggttcgtagtaccatgtcttgcagagcattacattcggccagtatgccatagatgccgctgcccagccgaggtctgccatgccgctcttgccctccggatataccatctgtccgtcttcattcagttcataatcaagtccctcgatgccatttgcagccagctgtgccgcttccggatcggtatataacactttcagtatcctcatagccgcttccggttctttacagaaggaactgatatgccacatataggttgttgcatcacttgtcgtggaaagtgcatctgtcacctttgtcccctctaattcgaggttgttctgtgcaatcgttgcctccatagacacctctgcatcccaaccgtacccggtcgttccgtttgccacgcccatcagcaggttcatcagggacgcattgctgttgctgagcggatccgggctgaatacgccggcttccttccactcttttacatgtcccagccaatttttaaagtattcggattcatagaaattctctacctttgtgctttctgtcggattcgtcaggactcccaggtaatttgtgtcgcccaggtagtcaatgctctttggaacccagtaagcctccgttgaacccgggatgtaatagctgtccggattcgccgctttaatctgcaggatggcgtcagacatactgtcaatatccgtcaccttactccagtctacatttgctttctgagcgtcttctgttctggcatagtaaagattttcggtacaataggaatacatacatggaatgccgtactgttttccgttaacctctccgcattttaagtactgttccattccatccgcgaataaatctgtaatttcacttccttcggattccagcaggccgtcaagctccataacctgtccgttcgctacgagattggaaaccgatgtgtaccagaaggagttaaataaatccagtgaatcatctccgccgcctgtcagcatcaggttcagctgtgttgcccagttaccgaattcaatccccaccagatccacctctgcatgggccttttctctcaaaatcttattcagttcttcttcaattgcttcttcatccggtgatgggaacacaacggaatatgccatttttattacagggtagtcttcgtctgccgcctgatcctctgttgctttctgcttgtcgtcctccttcttttccgatgagctgcaccccgtgaacagagccgccgccatgctgagtgcaagcaggctggcaattattcttttcttcataaactcttcctccttttcgtggatctcttcttcatttatagcctttgcgctttggcctttcgttgtcttgcatggacatcataccaaatccgaatgttgctcttctatcatttttttgtcctaaaacatcaattttttaatattccacactattttttttacattttcgtcatctttatatactatttattttttaaaatcagaattttgacagtttgaatccgttttttgatagaattttgtgcacctttccactacatttataagtaagacgccagatgccccgccgcaaacagcttcagatttgcagcacaccacacggcagagcgtttggcccttcggcatctgccaattggacatacataccagtctggctcgctgcccacgggaataaaggaacgtaaaaatcaaggaggttcttatgaaacaagaaaaattgaaagtcaagaaaaagggaatgtcaaggcgccggatgaaaagatatatcccgctttatctcatgatactgccaggtctgatttacttaattattaataactatatgccaatggccgggcttgcactggcatttaaaaaggtcaattattccatcggccttttcgagagtccatggtgcggactggacaacttcaagttcttattcagtaccaatgatgcatttatctttttcaggaatacaatcctctataatctgggattcatcttcttagggaatgcgcttggtgtatttgtagctatctgcctggattccatttataacaagtttttcaaaaaattcagccaggtgattatactgatcccctacctgctttcgacagtcatcatcagttatatcgtatatgcatttttaagcggcaataatggtttcatgaaccttactattttaccgatgttaggaatcgatccggtaagctggtacaatgagtcccaatactggccttatattctgatactcgtatatctgtggatgacgtttggatacagttctattctttactattccacattaatcggaattgataagtcctattatgaagctgcggcagtagacggcgcaggtgtctgggctcagatccgccacattacactgccggccctgaaaccaacgattattacgctggtccttcttgccgttggccggatctgctactcggactttggcttgttctatcagatcccgatgaacagcggccttctatactcaacgactcagaccatcgatacctatgtataccgtgccctgttagaactgaacgatattggccgttccacagccggcggtttcctgcagtccatacttggctttatctgcgtatttaccgcaaatgcagtcgtatcgaaggtagacaaagacagcagcttattctaaatacaggagggaaatttaatgatttacaaaaataagatttttcgttttataatgggattcatcatgattttattcgtgttggcgtgtatcctcccattcgtactgttaatttcaagttcttttacttctgaggtcgcgcttgcccaaaatggatattccttcattccttccgaattctctttatccgcttataaatacatctggagcgtaaaaggagatgtacttagggcttacggtatcagctttttagttacaggcgtgggcacggcagtaagcgtagttatgacgatgctgtttgcctatccgctgtcccggaaagatcttcccggaagaagagttctttccttcatcattttctttactatgctgtttaacggcggctttgtcccgacctatttgatttattcacggatcttccatattacggataccatctgggcattgatcgttccctacctgttaatgaatgccttctttgtcattatggtccgtacctacattaacacaaatgtaccaaatgaggtgatcgaggctgctacgattgacggttcaggcgaattgcatacgctggtaaaaatcgtcgttcccatgtccaaaccgatcattggcaccattgctctgatgactgcgattgcatactggaataactggacaaacggcgtatactttatccacaccaaaagagaacttttcggcatccagaactacttgaattcggttctcagcaacatcgccttcctgcagtcacattctgacccaagcgtaaagattactgaactccccagtgtcagcatccgtatggcgctggctgtgattgccctgttaccgatccttgtcgcttatccgtttttccagaaatcctttgccaagggaatcacggtaggatctgtgaagggttagaggaggccgccccatgaagaaaatagaaaataaaatcatgctcatcacttatgccgacagcatgagcaaagacctaaaagaactggatgaaatactggaccggcatttcagggatgccatcggggggctgcatgtacttcccttctatcccgcatccggtgaccggggatttgccgtaatcaattacgatcaggtagatcccgccttcggaacctgggacgacatcgaccggctggccggacaatattatatgatggcggatttcatgctgaatcatgtatcgatccgttccggagaattccaggattatatggaaaacggcgatgcttctccctacagagatatgtttatccactgggaagaattctggcccgaaggaaatcccaccgaagagcagtaccaggctttgtaccgcagaaaagctgtatatccatacattgaatttacaagaaaggacgggaaaaccgttcacttgtggaacaccttttttgaggaacagattgacatcaatccctatgctaaagccacgaaggattactatgccagaaatttaggcacaatcagcagccatgtccccctggtcagatttgacgccttcgcttatgcctcgaaacgccccgggacaagctgcttttttgtagagccggacatatggaacgttctggatatcggcatggagccgttaaggaagacgcagaccgaaatgctgcccgaaatccatgagaattatcaaatccagcttaagatggccaagaagggctattgggtctatgactttgctcttcctatgcttttactccacgggctgaaaagcggaagaaccgaccggctgatccactggcttaacatttgtccgagaaagcagttcaccaccctggatacacatgatggaatcggtgtcgttgatgtcgctggtttactcacagaagaagaaattgattatgtgagggacgatgtggatgaaatcaccaaagaagcaaagcagtacatcaagcttcccagcatgattacatcaaaggacggcaagtttaaaagctaccagctgggttccacctactactccgcactccggtgcagtgatcgtgcatacctgattgcaagagccgtacagttttatgctcccggtattccccagatatattacgtgggcctcctggcaggagaaaacgatattgagagcatgaagacgaacccggatcccagaaccatcaaccgccacacattctccagggaagagctggaagctgcggtccaaaagccggtatgtaagcgcctgtatgaactgatgcgtttcagaaacaattatgaagcttttaacggagacatcacaatcggtgaagaccgcggcgatggtacacttacgataacctggaaaaaagacaattattacacggccttaacagctgatttcaaagagcttacttatcagattgtgtattatgacgaagcttccgggcgggaatgtatcttatagttttataaaatatcaaaggagattacaattatgtcattattgacctacaattttgaaagcgaatatctaaacaacaaccaccagatcaccgtcattctgccggataagaagcgtggaatatcccccgcagagttttatggcagtaataaaaaatataaggttctctggctgctccacggtacatacggcgacgataccgactggctcagaaaaacgaacattgagctgtatgccgcagaaaaaaaccttatagtagtatgcccttccgccttaaactccaattattcaaactggccgaatgcaatgctgggttacaatatgtatgattatttcacaaaagaactgatgcccctggtctatggctggctgccggtatccgataaaagggaagacaactttattgcaggcctttccatgggcgggcgcggcaccattaagtttgcggtaaactatccacagttatttgccgctgccgctgtgctctctgcagtacctgttccatttgatgaactaaggcccgggcacccatgtctgattatggacactgcgaatccccgaatggtacaaacgatcgaaaatgcaggaggcttcgaggcttacgtgaattcagaagaaaatgtatgggccctgattgatgaactggctccaactggagatctccccaggctgatgttcgcctgcggacacgaagatgcaatcctttacgacagatataagatattccgggagcattgcaaagaaatcgggctggatgtcaaatggtttgatctgccaggatataaacatgaatggcgtttctgggatctcgcaatacaggaggcactggtgttctttgggctggaagatacggactgcgggaatcccttctaaatcgggagttagttaacgagctttagactcgttgacgaatggcggacgcgaatgacgaggtgagtccgggagctggcggggcaatgtctgctggtgaaatgtcctgacacttcgcgaagaagctgtagaagaaaacggaacgggaagggaggtacatgccgcatttggcccgaatgccgatgcattcgcgccgcaggcggcatcagaatttgcctggtaaggcaaattctgccctcccttcccgttccgttttcttcaacagcttctaatcgctcgctttatggacttttcaccagcagacattgccccgccagctcccggactcacctcgtcattcgctgttgcatccaaacggtagttaagagctcattccccagaggggccctcgtacggtagcaacggatggaacagaattggtgattcgtttatataagtgtaagtgttagatcgccttgttacccgtaaatatactggatttaatggggacataaaagtcccgccaattcaataccatacgctgcccccgtttgaggccccaccttaggaacgagtccttttcctgccggttggatgcgccagctccatgaagggatagctgaaagcctcccggagaacatccatgtcctttcaaaaacgctcaaagcggatcttagaaattcttggtgggaaacagccctgaaaatggagagatttttggattccgaatccaaaaatcagctgacccagcgcgagaaatcatcggatttctcgtgatgtgtcagtggtgctccattttcagggctgtttcccgcctagaatttcttaggtccgcggccgcgtttttgaaaggacgtggatgttctccgggaggttttcggctatccctttatggagcgcccccatccgcgccgagactaaagctcgccactaaatcccgatatagtccgcagctcttctatccccctaaagctcaatcaaatcatacttacgtgtcccaagcccaatcttctctgcatgttccagacagacacgccactcggattccggcgtagaatttttgaaatggtcatgatgatccacgaaatccgggctttccatattatgcgcaagctggcttccgggaattggagctgccttcaggcaggcatctgcacacgcctggtccaatgcaagagggtcaaaagaagcaaacatcccaatattcggcaatatcgccacatcgttctctccatggcagtcacagttcggtgatacatccactaccaaagagatatggaaattcggacgcccatccacgaccgctttcgtatactcagccatccggcagttcagctcactcaccgccgaactatttgtaaactcgattgcatcaaaattacacgctccgatacatctcccacatccaacgcaatgctctgtagccacatgcatcttattcgcagccttatcgaacaccagtccattgttagcgcactgcgcctggcagcagccgcatcctctgcaggcttctgcatctatatgcggcttcccgttataatgctggtccttcttccctgcacgagagccgcaccccatgccaatattcttaattgttccgccaaaccctgtcagttcatgccctttaaaatgcgtcaggctgataaatatatccgcatccataatggcgcgcccaatcttagcttcttttatgtactcgcctcccctgacaggcacatcgacatcatccgtccccttcagcccatctcctatcataatcgggcacccgacggtcataggagtaaatccgttttcccaggcacagtaaagatgctccagggcattcttgcggctgcccggatacagagtattgcaatccgtcagaaagggtttgccgccgaattctcttacaacatccgccactgcttttgcatagttagggcggagataactgatattacccatctcgccaaaatgcatcttaatggcgacgaatttctcctccatatccagatcttgaactcctgcttttttaatcagctttttcaacttcgcaggcaggccgtctccgaatgctactgtgtgaaaatcggtaaaatatacttttgctttttccatatctgtcttccttcctaaaaataaaagtctgagtagtggagactttttccaactcatagatttattatatctttaatgaccggaaaggtaaatcctaattttactaacgaaagacagcatcaaagcatctatacaaaagggccgcccttgatcatgatcggacggccgtgtgtataggtttggcattttattcacttttttcattctgaatgttaaacaattgcataacttcccccaaacaactcaatacgccgcccccgttaaagatcccctccccagtgccttcccggcctccctgtcatgaagcgtccccgtccgttgacaaggctaaagcttgtcacctaatatcccctcatatgcaagatctctgatttttggatgtatctcatgataagcttttggatacccaacaacatgctgtgcatagaagatactgaccttattcaccgtatcaatcagcacatatgctcctgccgccccatcccagccaaactcaccgaccggtgattttgacattctgccatccacaagtactcttacccccaggccgtattcgtatccggccttgccgcacatggcaaaatcccggctcatctgcccggttgtatatggcaccgtgaacatctttacggattcttccgagagaattctggccccatttgcgccttctcctccattgcacagtgcgtcgataaatatgctgtacgcatccaccgttccggcaaggccggccccgccgctttcataattggctgtgatctggaaaccctctgacaaggaaccgttatccggaacgatctcatccgtgccaaaaacccccatatgcagtgcgcagacccggtctgcctggctccgctcctggctcttatgaaaatagagatcctgtatgccaaggggttcaaaaatattttcttttaagtagtctgagtactttcggcctgtgataacctcgactaccgcagccagaacatcgtgccccagcccgtatgaatatctggcggcaggttcataaacaagcggcatcttcgcgatctcagcaatgacttctcttgtggaagcctgattgccgctcttttcccggaccgccgttatttcttctgaatcggtatcataggacagcccggctgtcatcgtcataaggtctataattcgtatgggattgtgggcgtagtggcatgggtctgatgacttcggccatcttatgggaaactcaaactgaaactcatctgccactttcataatcccgtattccggaagatactttcttacttcgtcatacagccccaggttcccccgttcgatctgctgcatcacggctgtcatcgtaatcagctttgtagccgaaaaaaatctgaaaaatgtttgttccgttatcggcttattcttttcataatccgcatgtcccaccatatggcggtaaataacttcatggccttttgtaatcttacaatctgctgccggaatgccatattctttattcaatgaatccatatattctgtcagcttatcaaaattcatttttttaagctccctcttatattttatcgtactctttctttcgatcaagcttaccggaaagacaaaacgcctgctgcctgcctgttcctcaatttccttcataagctggactgccgcagccgttcccatttctgcaataggctgtgcaacagagcttatctggagcagtttggatatttccagaccatcgtaggaaatgaccggcatctgatccagtatccctgtttcctgtacctcagggctgcagataatactcgaggccagcgcatcactggttacaaataatccatccatattccggtgcttctcaaaaccgcgtagaaactctgctgctgcctcgccctcatcatttcggcgctcggaagccaggatatgccccggatctttccccagtcttctgcactcctcaaaaaatccggtattcctgtcgttcataggcatatattggggaatatggtctccaaagagcaccggatgcgaacagcctaattcaattaatgccctggccgccagcgttcctccctgataattatctgacatcactgtggaaaagccctcaatctctctgtctatgctgacgatcggcatcgtggtttttcctgcatatattccggtgtctcccagcctgctgcaaaggataatcccgtctaccttattgccctccagcatggataccatctcgatttcccggtcttcattctcgtcggagcggcagagcattaacttataaccatttgcatggcatgtctcttctaccgcttcggccagtctgccaaagaactcatactgaattgacggcacaatcaggccgattatattgctttttttcttttgcagcgccctggccatttcatttggcaggtaattcagctccttcatggactcataaacctttttccgcgttttctcgctgatcggccctttattgttgattattctcgaaaccgttgctatagagacatctgcatgtttcgccacatctttgattgtcggcatcttgtcaatcccctttttccttcttttatccacattcctgttacgattcacggcctatggaccgcgcatagtaactcattcctttacatgtgaaatcatccagtccagaatcccattttcattgtgcagggtaaggatccagctgttatgattttctgcatccaattctttatcattaatcccttccgtgctgccaattccgtacttttccagttcttccggaagatacatggtatacttcacatccgtccttccctcgccccaaagcttgttgcaggcatttaagatgtatgcatgccggccatgctgatgatccatataagccgttgagatccatacgggcaccttaggccagtgcagcagctggggatagctctccccattcatgctcggacagatcggcagcgctgccgcaaacagatccggagccgtggaaacggcattgatcgttccgcctccgcccatgctcatgccaatgacatagactctttttgcgtctacttttccttcctctatcatccggcgtatgatatctgtgacctttcccagatagtcccggttccagcccctctctcccttgagcgcaaacggggtcattcccatctccacacggaatgggttgcctctttttctcatgacttcaaagttctcctgcatggtcagggaaccggctggggcctggggagccataatatacatatccggccacttctcggccagcctcagggcgcccagcgtccccgtcatctggagcacattgtcttccccgcattcacccccgccgtggagaaacagcaccaggggtctcgccgcagccgcctccggttcatatagcctgtagataacaccgttttccttcctggcagtaaatgtatccaaatcctttacgactacttcgtcaatgttatcttttgtgacctctatgtcttccccgccgatcttaacggtgattctaaaatcatatctgtataaaaacggatcaaacgcagccacaacaccgccctcagtttgttccacagatagtacgcctttggaaagggcttttccgctcaaatcacagaaatgtccttctatatcaaccgatacatgactcataattatttcattatcggtgataaactttatgttgtcaacagcctgaccataatctcctatatgcacatatgcaatgatttttttcatattcatctccattccgccgcctttggccggcggcacaaatcttgtctcttttcacctctgccaaatagatagtgcaccaggcaaaagcataaacgcttacaaaaggtcaccgtaattgcacggaaccatttctcccttaaacagatccttcatgatatccgccataaacgccgacagatccgcaaaatggtctgtgatgtatgtaaccccattacagcttgagacctgaaggccgtagaaatatttagcaaaccattcgatggataccagcagctcgttatcccggtgcagtgcctcacagtacatacatctgaccgtatcatcaataacgcacccaatgcttccccttgcaaactgcagccttcttccgtctttcaggatcaggacaaccgatgccgcatgatcctccgcctcatattccgcctcaaatacctccgcgataaacgacagtggaacacaaaggtaggatcctctgacaatctggtctccgttcagtccgtggtacttcagcttatcccattggaccgctttggtcttcaactccatcacctggtttttaaaccaggctttgtcatatcctcctgccacggcgatcccgaattcatcgcctgttcttggaagtttactttcctcatgggtgatagttccgtctggattcctcctggtaccggagaaaagataatcccaatacaaaaatgcttcatccagagtctgtccatggtccctgttcttaatatccaggtaaaccaggtctgccttgctgcctttataaaatgcaaaattattttccccgataatccggatctgggggatttgtccgcagtcattcagcttcatccagtagatcctgttcatcttattgatcgtatattcatcgtattcttttccgggagggaggccattcttttcaggtcttgactgccagactgcaagatgccccgccctgttgattatcttcccgtcccggtcgaagatgttcctgagctcgcagggaccgcccgaccccgccgcacctgccaggatatcgccgtactgccttgcaaactgcccggtcatgatattgcccatggacatgccctgcataaagattctgccctcatcaatactgtacttttccttcatcctgccgatcagcgcaagaatcatattcatatcatgatttttctcaatatccttaggcggcttcacgatcggaagatccggtgctgctgcaggatcaaaatcatcgaatactccgtaatttgcccacattcttttttcatgtgcattggggaaaagacagataaatccctccctgtccgccaccaatgtccatgaggtatagactgcatggccccatcccgtcataaggccgccatgcagcccgatgataagcgggacctttttggatggatcatagctttccggaacatattcataccagacatcttccaccccgtcgatgactgcctctttgaattcctgaagtcttttcggatacacgatcgaattgttgccgttttcattgacaacaatgtctgtatttcttattttttccggcaggtattcccgattatcatcatccggtgttccctgcagaattctgatatctgccatattgcttttcctttcacatggggttttggggaaaggatagcttttatttcacgctacctccccttccctttaatcaatcacaatctgctctttcacgccgcgcaggagattgcggataagatccgccatattcacgcctaattctgcgtgatgatccgtgacataaaggacatcaccgcattttgatgcacacatattcatgataaaacgtgcaaaccactccagtgaaatacacaattctccatcccggtgcagggcctcgcagtacatacatctgatctcattgtcaatcacacatccaatgctgcctcttgcaaactgcagcactcttttatcttccagatacagataggcaattgccccgtccgcttcatatttatattccgcgccaaacgcctgtgcgatcaaagaaaccggaacacagaggtactctcccctgaccttctggcctccgttcaggccatggtattttaacttctgccattttactgccggcgttttcatttcgactctctggttgctaacccatgctgtcctgcagccttctgcaacagctatggcaaatgcatctccggtccgaggaattctggatccttcatccacaatcgttccgtctgcttttcttctaagccctgaaaaatagtagtcccacacaatcgcggcctcatccaatgtctgtccatggtctcggttcttaatttcaaaaaacaccgtgtctgcctgatcccctttataaaaagcgaaagcatcctcgccaataatactgatttcggggtcctggcggcagccatttacttcattccaatacactcttgtgtatttataaatcgtctggtcatcaaattcgcaccagggcgggcacccatttgtttctgggatggaggtccacattcccaccggaccggcctcattttttatcttcccattctcatacagaaggcgtgggttcggcgtgccccctccggccccggatgccgctgtcagaaggtttccataatatctggcaaactgggaggtaaacatatttccattggacatgccctgcataaaaatccgctcttcatcaatattgtatttctccttgagatattccagtaaggcaaataccatttttatatccgggttgctctcattatccgacagattttgtttgatatcatcgggcatttgttcatccaccctccgctcaacctccgtagcctccatggtccataatcttcttgtatgggcatttggaaataccacgataatattgtctctgtccgccaccattgtccaggatgtatagaccgcctgcccccagcctgtcatcaggcctccatgcatggcaagtaccaggggcgtcttcctggacggatcgtagcactgtgggacatattcataccattcgtcttccgtttcattgcccataatcccatggaattcctgaaggttctttggataaggctgtgaattgtttccgttttcattcacaacgatgtccgagcctttgatcgcctccggcagatattccctgttgtcatcatccggcgtaccgggcagtatttttattttattctccattcttctccctcctgtggattatctgttaagtaacagttcaggcacgcccgaactgttacgcatccagctcatctaaattcgccagcggcgaagagccggatgcctgcagttaccatgttttcgtacggtctgcgcagacctgtctgaactgttactctgctacagcatatcgtcataataatcaggtacaatcgtatccatcagtaaatcttttatcagatctgccatgtttgccgacagcttattggaatgatccgtcacatataccacctcttcgcaggctgacacatgcatattgcagatatattctgaaaaccactccacagagacgtaaagctccccgcttctgtgcagtgcctcgcagtacatctgcaccagggaattgtccatgacacatccgatgcttccccttgcaaactgcagtttctttccgtctgacatagtcattcctgccgtcagattatcttctgcatattcaagttcagcgccgaaagcatctgccagaaatgaaaggggaaccatgacatactcccctctgattttctgtccaccttccagtccgtgatatttcattttctgccatttcagcgccgggccgtgcatattttgaatgcggttttgaaaccacaccttcgaactgccgggagtaacagagaaagcaaaggcatcgccgcgcctctccctgacgggctgcgtacatacgatggtgccgtctttttctcttctgattccggaaaagaagtaatcccagatcagcgccgcatcatcaaatgtctgcccatgatcccggtttttaatgtcataatataccacatctgcgtgctttcctttataaaatgccaggttattttctccctggattgtaatctccggaatcaggctgctttcattgatctgcatccagtacagccggttatatttatgtactttcttctcaatctcccttccggggggaattgcattgagttccggcctagactgccaaacggcaagcggaccgccctggttgattatcttcccgtccttattataaagaagagacaaaaatgcggctgctccggagccggcggcgccagccagaagattaccgaaatttcttgcaaacagtcccgtcatcatatttcccatggacattccctgcataaatattctgccctcatcgatgtaataggtcttcttcatcagctctatgagccccttcgcaagcttgatatcatggttctctgctacatcttcgggacaggacagcaccccctggggttccccttccattgatccgggggtgggtttttcggggtcaatttcccatgttccccactggacctgccagaacctgttataacttgcattcgggaatacgacgataaatccatccctgtcggcagccattgtccaagaggtgtagacggcctgcccccacccggtcatcatgcctccgtgcatggacatgaccaaaggtgtcttttgcagtgggttgtagctgtccggcacatagacataccactcgtcttcgatcccgtccgctatcacgccatgaaattccctaaggtttttgggatacggctgcgagttgtttccgttctcgttcaccacaatatccgtccccttcaatttttccggaaggtactctctgttgtcatcatccggcgttcccggtcttaaatacatctctcccatattctcctccttgtgaacagttcagaccgttccaaactgttactctccttatcctattccgcatcccgctgaaaagtctccctgatgtccagccagtccaggaactttttgacatggcggttgcagtactcccaattatgcgccccatggtcaatcgtcctctcgaatctcagccccattgcctcatatttatccataaatgcaacgttgtcttcatagtgcgtatcctctacccccgtagccatgtatcccctggggagttttttccctgcatccagctgtttcttaagcatatagactacatcgtcttctgtccccagtgtattggcagcatctccgaaggccgaggcaaacatataaaaatcgtcttccctgtcctccttttccggaagtatttccggtacatttttaattcctgaaaacagtccgaatgcagcaaacttctccggatcccgcagcatccatttgagagaaccataaccgcccatggaaaatcccgctatatagttttccttcggatcctcggacaggggaaataaatgtcttaccactctcggtgtttcaatggaaagctgtgtaaaatacttgaaatctccatgttttgtatccatataacctgaacagtatgtgccgctgcataccactgcgactcctgcctccgccgcatataattccagggccgtgtatctctgccagtccgtatagtcaaagccgccgcctgactgaagccaaagcaccggataacggtatcccttcggcctgtccgccagggaatgcccccatgtattttccgggataattacgttcactcctaccgtcataagcagtgcctccgaaaaataatgcaatctgaaattcgccattttcttttcctcctactccaatatgtttatgcctcctatgtccgagccgttcaggacacgatccatttttcattttatctgccgcataaccatgctatggcctttttcaataccattggttcactgaaatccatgatttccccttctgtctccaccagaaccgcctgttcctttaaggattctgccaggcgatttctctctgccgcatagttagaagttttggttcctgttatgtaaaactcccctgcccggcacttcttcgcaagcgcatacacatcatgcacgcttcccggtatttttgtaatatcgccgaacacggccctgagtgattcctcattgtggaagatgcctgtcggttccccgttcattgccagcctgcagatgtgatccatatcaaagatcccgtccatagcaatacattttgtaaatatatccgggtgcttaagcgcagcttttaccgccccgtaagcgcccgtccctgttcctccgatccagttcaacgccggatcttctgaaatgggcagattatttctgcagatccccggcagctccgatgcaagaaatttttcgtatttggggccgtaatccatgttcgtacaaatggaatgctgcgcgtctggcgcgatgataaatatgccgtattctgctgcacaacgctcggccatcgtcctgttccagtccagcgacgtcccgccctcgctgtgaagaagccataataccgggtactttttttcgtgtttttcatcatccaggtctaaccggtccatttccggcagatagatcttcgcactgaatgatccgcacaaaatcgttgataaagcattgagttctaaataagccatcagttctcctcctgttcttgatgtactaattatatcttctcatcgcagatgtaaaatgtcaaacgtttacattttcgattttccggcttattttatcgatttcttgacttgcactttcggttttgttactatgaaatcagctctatctttataaacgtttaacctgggggattctatgaaatttttaaaacaaaagaggccatattctattaagaaatttttatatagatactttctgttattgtttctgtgcacttccgcagtgctgatcttttactgtgtcgtttttatgaagtcttactccgaccaaatgtcctccaatgcagctgccaggatcgactactattccagttccctggaaactgaaatgaaaaaatgcacctcctttgagcagaagttatgttactcggacagttcatttcaattattaacaataaaaaatttaaaggataccgataaggttatcctccactataatgtcaccgagatgctgaaacggcaggtcgccccctatgaatgtatcttcattttcgataaagaaagacgggtatccacctatgcggcaggagaatccttttcttctaatgggacacaatacatctaccagttgaaggatcatttaagagattattggttaaatgaaaaccagacaagttataataaatggatcgttttccaggatacgcaccacactgttttaatgaaggcacttaaagtcagagatgtatacgtatgtaccacgattgatctggaaaattttgaccttctgacgtataatgaatcagaggacaatccggttcagttcggtttttttaataatacggaaattcttacaaaccagataagtgtcactgaggcaggaatggatttgacaaatctgacgtatcctaaaaacccgtttttttctaattattacataatgactacacccatagaggaaaccgacatcagcatgttttgtctggtctattccgactatatgggggattttgccaaggtatccattctcgtattcgtcctggcagcgctcgtgacctgtatcattatcgtttatacattttattcctttcataaaatactgctgtacccattggatcagatcaatgcagcaacaaaacatttagaacagaacgatccggcctcatttttatccgacagccacagcaatattatcgaataccagaatattaataacgcactgtcaaacctgatcgaacaaaagatcactttaaccaatgaaaaacaggcggaagcctttgaaaaagaccatgcacgcctgcagtattaccaaatgcagacccgctcccatttttttatcaactgcctgaaaagcttatacaatatgctggaaagcaaagaatacgaaaaaatgcagcggatgatcatcgctttctcaaatcatctccgctacattttccatgacaacttaaaacttgtcactttacagtctgagctggcggaggtaaacgactattacaatatcattttgctggaccgtgtcagcccgtttatcctgaatacacaggttgacgaaacattgcttccttaccgggtgccgtcgctgatcattcagacgtttctggaaaacacagccaaatacaacagggaatccggcagcctgctcatctttgacataaagatagaacgcgctgagctgaacgggaagccggttatgcagattatgctgagcgacaacggaaccggatatgaccaggagacacttgaccgtctcaacagctcggaaaatgatctgtttgccagaaagcacgtgggaatttcgaatttgaagcgcagaattgctctcatttataaaacagattatcagtttgctttctataataaacctgccgggggcgcttgcggattactttatctgccgctcatagaagcgccgcagttttaggcatctgccggcagaagccacctgcagctgccaggcatgccctggcccggacactcagagtgctcactcatacaaaggggagaaatcatgaatcttttaatcatagacgaccagatctccgtactggatggaatccttaagggggtggattttgcatcccttaagatcgaaaacgtttatacagcaaccaatgtttcagacgcaaaagatatcatcaaatccaacgatatccagatcctcttgtcggatatcgagatgccgggggaaaacggcctttcattaaatcgatggatcgccgagaattatccggttattgtcagaatcctcctgacttcccatgcatctttcgattacgtaaaagaaagcatgaaactcggatgttttgactatattgtgcagccggccccctaccacgagattgaagatgtccttatgagagccgtctccaaaattctcaccaggcagcagctctctgattactataatttcgaggtgctcagcaatatcgtcctgaatttattttcttccaatccgtcaaataaggagcagtcgctggtttccttgaaccagatggggtatatgataaaaaatgaatcgaatgtgcaggccattattattgatatttattcctacaccgattctgtggaacagtcgctttccgactcctcgatctcggtcattctgatggaacatgcacttagaaactttgccaagcctgacatttacccgctaatctgtctgaaccggtataagcagtttgttctccttatgtactgtaacggagattctctcaccactcttgcgcccgatatgtacagctcctactatgaggatatctgcggcaagatcagttccgaattggcctgctacgttacgccccgcagccaggtggctgcgattagggatatcatattacccggacatcagcgggcagtaaataatgtctcccgaaaaccgggcctgtatttttctgacgaggatatgcccgtccctgaaagtacgagcctttcggaaaatgtagtacggtgggagcgccttttagagaataatcagtttatatttctggaagacaatatcgattcctttttagattacaatacctctctgaacagattcaacctggagacactttcagaattccaccaggaattaaccaagctgttctttatttattcctataaacggaaaattgatatcatgagcctgttttccgaagaatacagctacaacgattatatgagctgttttaaagatatccggtcgctgaagacgggaatcagtttccttatcaccgccatatcaaacgcttcctgtgaagatgactctaaagataccgtccagcgcgccattgattatatcctggaaaatctttcgaaagacatatcagtgaaggatgtggccgactatgtatgtttcagtccggaatatttttcaaaattgtttaagaaagaaaccggcgaaaatgtaaagaattatatactccggatcaaagtggatgccgcaaaagacctgctgaggaatcccaatattcctgtcagtatggttgccgcagagctgggatacagcaatttttcccattttactcaaatgtttaaaaaacatgaaaatatgactccaagcgaatacaggaaacagtttttaaaacatatttagtatggagcaatggaaacgaaatacaggaatggtaacagttcaggcccgccagcactgttacccagaatgcgaaagggattttaatgatgaaatacaaacatattatctttgattttggaaatgtaattgtaacgtttggagaaaagcagcttatcggacctttctgtccgtccccggaagattctgctataatgaaacaggcaatttttcatgcctgggacgacctggatcgcggcaccatagactatgaagagtatatggaacacgccgcatctctggcccctgaacgcctgcgtccaaatatccggcagtttgcccgcgaatggtgtctgcacctgaccccattagaagaaacatgggaattaattcatgatctgaaaaagaaaggattttctctatacatattgtcaaacgcctccgcacatttcgccgcacacgccgattactatgagattacgaaggaattcgatggaattgtattctccgccccggttcagatgatgaagccggaaccggatatataccggtatctgttcgagacctatcatctgaatcctgaggaatgcttcttcctggatgataaagaagagaatgtcagaagcggcaatgcttttggtatggacggaattgtgtttaccggtaatgttgccgaggtcagaaagattctggaagtatagatgcgccagatatgccctgccctgcaacccaccaggcttacaggttattgtgaagcagctcgagcactgtgcgcagatcctctgccttcatctgccccggtgccgaagccttccccgcagatccaaaagtcagagccgaaccgaatacttccccgcacaggcggctgatcacaccggcgccggccatagacatcgtaataatcggccggtctgcatgtacagacaccatctcttccgtagctgccagaagtgtcagcacgtcttttttattccggggcataacagcgatcttggggatatctgctcccagtgcctgcatcctgcatagtctggatacaatttcctctttctccggcgttttctgaaaatcatgattggaagcaatcactttcacgccgtgcccatgggccgtttttaccacccgtttcactgcctcatcccctgtaaagatttctacatctaccagatctacatatccagtctctgcagcttttatattcagttctgcatatgtatccgctgctacctgcttttctccgccctctttggcggtgcggaaggtgaaaagaagcggggtctctccgagaactttcctaagttctttcaacgtctcttctgctttcgaaaaatcgaaaatatcctcgtaccagtctgcccgccattccacgacatcggcgttgatccgcacgatgtcggcggcagagcttaaaatccctgccctggttacttctactattggcacacagattttcgggattccgctgcctatctcaacatttctgatttttactgtgttcataggtattctccttttacatatattgatcttatcagcagtcttcaggcccatataatagtccggaagtctagactatttacaactttttctaccagtttaccataaggcagacctataaacaacgagaatcgggatttagtcggcaagctttagccttgtcgacggacggggacgcttcatgacagggaggccgggaaggcgctggggctgtatatgccgttgcaatatgcacccatgctgctaagtgtttctagaacagccgatgccggatagacgggtacgctgaacacatcacgggaaatctgatgatttcccgcgctgggttcagcaaaaacttgatttggagatcaagtttttccccgcctatccggcatcggctgttcaagaatcactaagcgcactccagcatatcgcaacggcatatacagccccagcacctccccggcctccctgtcataaagctggctcatccaatcggcaggaaagctcgccaaccgggtgggatcccggaccagggcagcggatgtggattggctatgcgtatcttttcatcttcaagatgtgtattgagttattttgatactgaaaccgtatcccatcgcttatgtaaacctactggcgacatagaagtcccgccaattcaataccatacgctgcccccgcttgaggcatctccttagaaacgagctttttcctgccggttggatgcgccagctccatgaagggatagccgaaagcctcccggagaacatccatgtcctttcaaaaacgctcaaagcggaccttagaaattcttggtgggaaacagccctgaaaatggagagatttttggattccgaatccaaaaatcagctgacccagagcgagaaatcatcggatttctcgtgatgtgtcagtggtgctccattttcagggctgtttcccgcctagaatttcttaggtctgcggccgcgtttttgaaaggacatggatgttctccgggaggttttcggctatccctttatggagcgcccccatccgcgccgagactaaagctcgtcgctaaatcccgatttttttgaaaacaggaatttcttccaaaggagcattgacagttatcagctgtcccccctgatatgtctctccgctccaggcatgttcccagctgcatcctgcaggcagatacagctctctctgacgcacctcttcataaagtacaggcgcgaccagcaggcggctgccaaacatataagcgtcttccacactccacgcctttttgtcctccggaaactcatagaacagaggacgcataaccggggttcctttttcgtgtgcttcctgcataagtttttttagataaggcttcatgttctcccggtactgcagatattttttcagaatctcatacacctcttccccataagaccagacttcattgtcagcgccggatacgcatgccccgcctccaatctgtgccattggttctttgtgcggctcgcggtcgccatgcagcctcatgacagggcagaaggtgccgtactggaaccatctaacaaataattcacggaatttcccgtcatccggattccctccgtgaaatcctccgatgtccgttgtccaccagggaattccggcgattcccatgttcaatcctgccgtaagctggttcctcatactttcataactggaatggatatcccctgaccataccagtgcgccatacctttgcgagccagcccatgcacatctgagtagatttacgatctctttctgtcctgcatccttcataccgtcaaaaaaggttttcgcatacataagcggatagatattcccgacctggatgttgggccccaggctgtaccggtactgttcaaaatcatagacggtgtattccggctcggcctcgtccagccagaatatacggattcctttctcgtaataattctgcttcaccttgccccatacatattcccgtgcgcctgggttcgtggcatcataatgcagggtattcccctgaaagtccatggcaatctgaatcccccgctctgtatggatcaaaaagccgttctctttcatctcagcgaagttttcgctgcggtaatctacctggggccagatggataccatcagctcgatgcccatagattttaattcctctaccatagcgtccggatcgggccaatattcatcgtcaaaacggtagtctccctgataaggccagtggaaataatcaaccacgatcaccgagatcggcagattcctccgcttatactcccgtgccactcccagcagctcctcctgggtgcagtaacgcaatttgctctgccagaaccccagcccatattccggcattttgggaaccgtcccggtgactgatgcataattttcttctatttctgcaggtgtatcacctgccgtcacccaataatctatctttttcgaagactctgcctcccatgtggtcttatttctgccaaaaaccactctcccgactgccggattattccacaagaatccatagcccagagaggaaatcataaatggcacgcttgcctgtgaattacggtgtgccagttccagatccgttcccttcagattcaggaagggctgctgatactggcccataccaaagattttctcttctggatccagtgattcgaagcttacaattaacttataatcgcttccctgcaaaggcttataagccctgccttcgatttcaagcgcgctgcatttggaatcaaatacatccctgcggttccttacgtattcttccaaaagcagttttcccgcattgttatagatccgcagctttcccgcatgattgatggatgctgtaattttcccgttacgtatggtgccttccgtctctgagatatttatttcgcaccacgattctttctgtttcagaagtgcccagtcttctttgggcatctcatataacctggctgcacgcaccctcagcgaatctttcccccaggcttccacccgcacagtctccgaatcataacgaaattccagggctccccctacacactttaatctttccatctgatttcctcctcagagttaattcttattttctatattaaggaaccaaagtggacaagcccgcttcaactcctcattcacacaccggctttgcattattcctcatggccttccccgcgcagaatcgtctccacatactgttccctgtacttcttcggggacatacccatgacttcccgaaagatattgcagaaatatttatcattatcatatccggttaccgctgcaatctcataaacctttaaatctgtctttcggagtaaaacacaggcatgttcaattttcaccttttttacaaaagccataaacgtgattttcatctcttcatgaaatatcctgcttaaatactccggcgacacacgcaggttatcagccgcatcgctcagccggcaccttgcgcttatattcttcctcacgtagttcaccgcattgcgcaccatggattttttcgtatcgatatcagcaagcagctcctctaccgctgcaactttcaccgcctgcttcacctccctgggtacagaatacccgccaagggttgtgtatgccttatttaccgcacgctcgatatccccataagataccggctttaaaatataacctttaatccccagctctatcgcttcctgggcatagtggaattcaccgtaaccgctgataatcacatagtttacctgcattttttttgattgaaggctgcgaatcatatccagaccggacatccccggcattttaatatctacaaatgccagatccggcagctgctttaaaaccagcgctctgccctcatccccattcgctgcttcccccaccacctggataccaggatctgcctgtctgagaaggcggataatcagctgtctggccttatcttcatcctcaataactaccactctcaaatctgtccccccatccttacagcgccggaagctttaacgttacggttgtccctctgccgcctttgctcccgatactaaaaataaacgccgctccataatacagcctcatccggtagcaggtattcgccatccccaatcccagattttcagggctgttttccagggcaatcccttcccttatcttgtgcagaatgtcttcctcgatcccgttcccattatctgaaatggtgatcaccagccccgattccgcctccttagagcaaataacggtaatgagcccgcctttgctttttctgtcaaaaccatggataattgcattctccacaaagggctgcaacagcagtttgcgtatttttttctcttcaatctccgggtctacatcaatctcaaaatcaaaacgcccgtcaaagcggctcctctgcagaaacaaatactgttccagccagacaatctcctgctttaccgtaacaagttcatacctgttttctgtcatataacgcaggacattggcaaataccttcagcagatcacttgtttcatagtcctcatgctctattgccgtgtaattaatggaattcagtgtattatagataaagtgtgagttgatctcaagctccagcgccttgatctccgcatccttctgttttttgaggccggtcagtttttcttcgttttgctcctgaatttttcttttttggaggacaatctgatccaccattttattataaccggcaaaaagggagttcagttcggcattgccggcggacggcagtgacgtatattcaccttttttgcgtatcttagacatggctccttccagaaggcgcagggccttcatcctgcggcggataaatatattaactaatagaattgtcaaaagaaataataccgatacaaccgaaaaagccgcaagtgttgaccctctgatatcttttctgattttatccgtatccacggcataggcaagatgccagttcgtccagtgcacttcgtcttcgtgtgttttatcaacttgcagattatcgataaattccaggttttcattatccgcaaaaaggctgccgcccgtggtttgaaggatataggacgtgtatcccccttctgaactttctaagatggactctattgtctccggatacatgagcataacaaggcttccatagcactccttggtcttataattataaattttctgggacagccccagacacatcttgctgtgatactccagcttagcagtcaccagctcctggttgtccatcccttcatttcccagccgtatcaaatcttcgtaaaacatcttattatttttagtaacaataatctgctgccctgccggaagacggattgtgagatatcctgactcatcttttcgcatcaaaaacatgagggccacctcattgttggtaggagttgaatatccttctaataaagaaaatatccgattgctgttgctttttacatccctggtaacatcctcgatctctgcccagatacttccgtcaatgaccgccttgtaataaggctccatatagcgctgcatataattggacagatgttccgatttatccaccatattctcagatgcggccagcgttgtatgccggatcatatcctgcccgtgatagatgttcagtgcaagcagaatcataataaccggcagatatgtaaataccgtaagcagaatttgaatctgcgtgctcagctgtgccgccctgtactttttcagcagtctttgtactgttgcgataattatgcataccctttctctgcgatattttttgcggcatgaatccatttttggatacgctccggcttgtgctgtaccgtaactgtatccttcagaatcatttccacaacacagctgccggctatttccatagtcttttgaatatcgcgttcagccatctctccgtcaaaaccctgggtgaccactgtcggagctggcttccatgagtatatgtaccgatccgaaagagcactggccgctgcctccctgtccgtccacggatttaccgacacgcgtcttaaattcttaatacgcctctttattatatcaaatttatccgtcattggctcgcagcatccataacaactccatccaaatctttccagcagaggctgatggtatgcagttgcgaattcctcatacatgtccggcgatacaccggcaagctcctgggcatctgaaaacccccagctgttcgaatacaatgccctgtccgcttcctgcccccgcatatatccgataccaccggaaccaatatagtcatttccggtatttgtatccagaagataaggttccatcacgtctaagagctccagtgcagcatctttcataaagtccagcaccttatgaagccactcaggctggtcatacagatcataaaaaatttgttccgtgcctctcatctcgataaactgcctcagaaggcttgtgtccggcgccaggtatccgcagtgccgcacttcgatcagatctccgattacttcctgtatcagataaagattccttgccgatgcttctctatgaagaaaaaactccggtttgaaaaacttttgaaaatcttccatatgttccagaagtattttcttctgatgtatcccctccccggtatctttcatatccatatgaataaaagaagctccgcctttcataaacggtgtgatctcatataccagcggcacttctatcaccggctctattacaaaatcatcgttaaaatgttcatacctgtaacagaggcggcgcagcatccattcgtatgcccggtagaattcatctctgcacaccatatcgtcccacggcagaatctcaagccaggccccttccggaaacacgagcaccataggccttaccctctgcagactgttatgtgcataccacagctctcttttcttatcctgtttcgcgtcctgggcgtaatgctgtacctttgaggcaagttcccgaagcacattcttttccctgtcgtttaaaccggttttcggtgcttctgtatagatgattctggggtctatatattcgatcaatttcttcacctactcctttactgcgcccgccgtcagcccggacactatatacttctgcatcaaaatgaaaataattacaatcggaataatcaggcagactccaaatgccagaatactgttccactgtgtcccgtattttgtctgaaaattattaatcatagtcgtcatcggccagagcgaggagtcggaaataaacgccatagaatataccaggtcattccacgcaaaaataaaagaaaaaaccgccgccgtcgcaaggcccggccgggcaacaggcaccatgatcctggcaaaagcgcccagcatcgtacaaccgtccactctagctgcctcttccaccgatttcggaagggatgcaaaaaacggccgcataagaatgacgataaatggaattgataaagtggccgtggacagaatcggggctatcctggtgttaatgatgtgcagcctggtatacagcagaaacaatggggtcagaagtaaagccggcggcagcatctgggttacaaggaaaccaagtatcataggctttcgggcctttgatttaaaacgcgccagcccataggctgccgggattgctaaaacaattgcaatcagcatggaagaaaccgcgattacaagactattccttaatgccggaaacaggctgctttcaaactggtctatgtaagcctgcgccgtcggggtttccggtaaaaaagtgggagggaacctgaagatttccacatcttttttaaaagaacacatcaccatccagatgacgggcgacaggaataaaatcaccagcagaactgctcccacattgattcctaaatttttaattctgccttttctcatcactcaatcacctcatcatcattgacaaatctcagataaatgactcctacaataaacaatagtataaacataaagttagccaccaccgacgcctggctgaaattgaactcacgaaatccgagtttataggcataggtcgacagcatttccgtggcatttacggggccgccccctgtcatcacctgaaccaggtcgaataccttgaacgtgtatatcactcccagaatcaagatagaatacatggttggcctgagcatgggaagtgtaatatggagaaaccgctgaatccttcccgctccgtcgatggaagcactctccagcacattttccggtatgtttgcgagacctgttgagagaagtaccatatcaaacggaatccctacccagcaattggcagcaatgatgcaccagatggcagtcctctcacttgtcagccattcgaccggactatgtaccacccccatctgctgcaggataaaattcaggattccactgtctgtctgaaagataaacttaaataaaatccctgtcactgtcattggaatcagccagctgaccagcaaaaggcttttggaaagctttgccatgcagaactttctgctaagcagcatggcaaaagcaaatccgatcacaaattggatgacagtacaaacgacggtaaacaatacggtgttataggcagccgtccagataacgcctttatccagaagttctttgattgtatcaagccccacgaactgatggttcataaaatttctggttgacatgtttctgaacatcagatagaagttataaagaatcggatagactgctatgatccccatataaatacaggctggccctgcaaagcagaataaataccttgtatttttcgttataattgtacgttttcctgtcccttttttcatttttccaccagtccgtcaatggctgcctgggcatctgcacaggcattctccgctgttttttgtcctgtcattgtctcctgcaaagccgtataaattgccgtagaaatctccggccagcttacatccggccccagtactgccgcatagttcaactggtcaaagaatacctgcagaaccgggtcgtccgcccaatccgaatacttatctaccgcatcttttctaggtggcagcttgcccactgcatgatcccagtcggccagtgtatccttgtccatcataaactccatgaccggccagatcttctctacatccgctcccttgacgatagagaatccttctccgccaagggcagacgcctgttccttatcaatcggtatcggtgcacatttccagttcttatccggtacatttccctccagtgtaggtacctgccatggcccgttgatcatcatggccgcattcccctgcataaactgctggcatacatctgcctgtgaccagttaatcacctctgaactcatagagcccgcatcaatcatattctttaaaaactgcatagaggatattgcctcatcgcttcccattgaatacatatcggctccgctggaatacaggaacggaaagtactggaaagtcccctcgtcattattcacaagtgaaagtgcaaatccatactggctgccctgggtcagcgccttcgctgccgacgccagctcatcccaggttttgggtacttctacgccggctgcctttaactgatcctcgtcataatacagcgccagacagttggaattataaggcagtccatacagctttccttcaatcgttgttgtattcagggatgtttcataaaaattctccgtctcgccccatgtctccacctgatccgtaatatcctgcagcatccccatttccacatagctggccgtatcacagttattaatcatcgtcagatcaggcagttcccctgaaaccatccccagggtatactgtttattcaaatccccataagggtactgcacaattttaaaacggtacccgttctcttccccccacttattcataatatctgtaaaatattcatgctccaggtcttcaaaatactcccagatctccacctcaacaatctctccatccccctcagaggctgtcccattaacctcctgggtaccctccccttctttcgccggctcctcagccgctcctttcccacacccggccagcaaacacaaagtcatcattactgcaagaatcatactcattacttttttcatagcttttcgcctccttttattacattatatttcataaacttttcctttttaattataacattttgataaaagtgcactattttgttattttaaaatatattcgtcttgtagtgagaacagcaatgccttttagactgataattttgcactgtttgcgcagagaaagcacctctttgtgatagaatcttttgccaaagattcatgcacacaaagaaaggtgctttctatgatttacaatatacaacattttattgaaaaaacttattgatcgggaagcggccggcagccgtacatcctgcttctcactgaagcccctccagcccaaatctcccgcttacataagctgcgtctcctccagtttctctgagaatgcagtgttaagttttataactggctttctcagcaccagccccagcataagtgatgccgccaggaaaatccccagtatccccagttctctccaatacgtcatcccataagccccgccgatgcactcacgcatggcggtcatactatgggtaaacggaagcagcggataaaccttctggaaaaatgccggtgccacttcaattggaaaggtcccgcctgatcctgccacctgcataaccagaagcacaacgcagactgctttcccgatatctccgaaggacacggtcagggtatatatgatatttacatacacaatgctggtaatccagccggccagcagaaacaggaacggatgctcacactggatctgcagatagtaaagatctcccaggcagataagcccgctctgaaacagtcccgccagcaggaataggatataccgcccaaaatagacttgataattctttacacgcttcagtccgttcagtgaatttggagatacggtaaccttgagcattgcaaccagtacgatgccgcccacccagatcgccagggtggagtaaaacggcgccatggaagaaccgtaattctctatgggatacagcttggttgtctccagttctaccggagaggcaaggaaggcgctgatgctttctttattcccgcctacgatctgttccagcgtctgaaaatcgccgctgctctgcgcctgattcagcttccagaccgtttccgtcagccgtgaggccgccttatccagcagggaaccggacgtgtccagcgtttcttttatctgtgacaggtctgacgaagcagaaccggataaagtgtagataccatcggcactctcatccaactgtttcagaagcccggatatactgctccgggtatctcccagagaggcatagaggccgtccagattctgtttaacctgttcttcatactcactctgaacctttgacaggttctgtgcattctgctcaaggagggcgtccagttcttcctccgaagcaagagcttcctccggcttgttccggatcgtctccgccgctttgctcagcttatcataaagagactgctgaacagctatcgattcattcagttttcccacaacactgccaatagcaggggcaattaccgcatgttccgctccaagtgcctgcagggcatcccgcaggttcgtataggattgtatgatggcactgatcttttcagaaaacagatccagagtggctgcggttgcagccgcatccgatgacagggaatccagtcccccatgaatcgtttcccccatctgttgataaaaacctgcgctgtccgccagggcctgattcatgccttctgctgcacctgatatggctccctgcatatctgaaaatgagctttctttctctttcagcgcactcagagtgctgtctgaatgctctctggactgttttaaaaaccctgatgtggtatccagcatctgctgtgtagacaccaccatggaagaaaatgcctggattgtacccgcggccgcgcttaaatcggcggaagtcctttccaggttcgttatcagtgtggcggcaattgattctgcgccctcctgttctgccgtatctgctacagcctgcatggccgtaatggccgtgtcggatatggtttcaataaacacttcctttacctgtgtctgcacggcgctggcacccttgtccgtgaccttgggcgctatcgcattttccttggcattggaataataagtgatctcagggttcgtaactgcgcctgagaagaggctcatcatattcctgctgaaatcttccgggatcacaattgcagcgtaatatttaccggatttcacaccgtctactgctttggcgctgcttgtaaaagtccagtccagctgtgtattttcccgcagcgcggagagaacattctctcccagattgagtgaaaccgggaccagctccccctcatacccttcatccacacttgccaccgcaactttaaggtttcccgtattctcatagggatcccagctggcggcaatgttaaaccatgcatacagagccggaaccacaacaattccaagaactacgatcagagcgatgacatttttatagcaccgcttcacatcctgtctgaagatgctccatatattcttcatcactcgtccctccctttcattgcatccagaagctcttcctgtgtcagtgagcccagctcaatctgccgctgcagtcggtcgtggatgtattcctgacagatcagataaaccgcgattacaataattgatacaatccatagaaccagaaagacaatcttcgactctatgctgaacatcaggatcaaaaagaccgccggaaggatcagaatcgctaaaaagccattacggatccgtttcttatagcctgcttcaaatgcagcggcttttgcaaccagctcttcccgcatggtctgatcccgaagcagtgtcctgactgccagggagaagggcgtctttcccccatttccgtccgaagtttcgcagagcatcaagtctgtctctccgagctttctgtcaaacagatcattcagattcaccagcagccttcgcagtccaagcccgatcagcagggctgccggcagatacaccgccagatggagcaggctgccccagaaggcatttccatacattcctgcaatcgcctctctcattgcattgattccataagtaaagggaagcagagggtgcagcttttggaagaacggcggcgtcatctcaatcggatatgtacccgcagatcccggaatctgcagaattaccagtatgatacaaagcgccttcccaatatgcttcagcgcacttgacagggcatagatcaggttcacatacacaaaggagcagaacattcccgtgagtacaaaggcagcgggatggaggcactgcaccttcaaaagccacaggtcccccagacatacgatcagcccctggataaggccgatcgcagcaaagagaagccatctgccgaagtatgcctcggatgtagagaaatgcctgacaccaccgcctctgtcaacttccattttaagaatcgcaattaatacaattccgcctacccagagcgccagatttgtgtaaaaaggagtcatggaagaaccgtaattctttacactgtacagagtttcacttcgaatgttcaccggcgatgccataaactctgcaatggagtccgcgtccagcccctccagtgaaagaaattgctgataagcctccgaactctgcaatgtctgcagatccgtcacaatccggtccatctgccccttcaaagaggatacagaatccccggtcctgcccagcgccttagaactgtcctcaaggcttgtgcctagctgggacaggatttcctccaactggtctgtggaggccgatacgccagacagcgcagcggacatttccccgcccagggcagaaaaagtatccattgactcattcagctggggcagaagcgtctggtcaaagttcgtacggtaatcccgcagcgactgccggctctgagataccagcgtttccagctgctccttggtgctttgcgcggtgtccattgcatttcccatactggcattgctctggctcaatgagtccagaagagtttgaaactcctcattctgcgcctgcagctcagcaatacgtccggaaacagcctccttaagcgcatccggcagatccgcattgatttcctccagcttttccagaatactgctgtttgtatccaccagattctgtaccgaatcaattccatctttcactgccccgttcaccgtgtccgcctgattcttaagggaactcaggctgtcggatgccgagccgtaaatattgttaagccagttctccccgtccgataggctgccggaaaatgcagaagaaaattccccaatactgcctcgtccgctgctcagtacagaagcagtatccgacaatgtgtccgaacccgctgacgcagccgatttcacactgtccagcacttcctgcgtattgctgatctgcccggaactatctccgaccgtgtcctgaaaattcttcagcacagtctgatactgccccagattctgctgaatctcagacagcatagacatcacttccgtattcatactgcccatatccccggaaagccgggtgaccgagctttggatcagttttgaaatcgtctctgccgccacagaggaaaaagtgtcgttgatctcctgctgcacggtgcctgcccccgtgtctgtgatcttaggagcgatcgcatttttcttttcattaatatagtaatccagccggggctttaccggataccccgagataatgctcagaagcgaactgctgaaatcctccggtatcacgatagccgcataatactttcctgacttcaccccttccacagcctgggattcctccacgaatgtccaccccagctgatcattttccctcagattctcctcaatacgatcccccgcattcagggtaatcagttcattttccgcttccgtatcatgattggccacagccaccttaatcccctgcgtattgctgtatggatccatattagcggcaatattaaaccacgcatacaaagacggcaggacacaaacgcctgccatcacaatcacggcgacccggttatgtacaagacgcccaagatcccttttgaatatccgaaatgcttttttcataatgaatgccctcctgcatatatcgggttaagtataacaaaaacaaaccaggaaaacaacacaaaaatgacgattggtcatattttttataagtttcggatgaaggtggatgaaaggacgcctgacatagaacgggacggggggctggctcatccaaccggcaggaaatctcattccccccgtggggattcccggacgggtgcgtcggatggatatagatgataggaaatatttttgtgcagtaaattactaggtctatataaacaccccaaagaggcaagatacacacaggcgatccccatccgctgccctcgtccacaaatccccccatgaataaacaatacctgccgattgaaagagccagctctatgtcagggatgccgggaaggcgctggggctgtatatgccgctttgttatgctagagtgcgcttactgcttcttaaaaaaccgatgccggatatgcggggaaaaacttgatctccaaatcaagtttttggagaacccagcgcgggaaatcatcagatttcccgtgatgtgttctccgtacccgcatatccggcatcggtttttttagaagcagttagcagcacgggtgcataacaaagcggcatatacagccccagcgccttcccggcatccctgacatagagcgtccccctgccaccatgcatcctctggtaaattcatcaaagattccgcaccttaaattcccgctgcgcctctcgtttctgatctttcttcgcaatatcttcccgcttgtcatacatctttttccccttagccagcccgatctctacttttaccagactgtcgctgaagtacactctgagcggtacaagggtgttgccttgttctttcatctttccaaacagcttatttatttcgtttttatggagaagaagctttcttaccctgagagggtccttattgaagatattgcctttctcgtacgggctgatgtgcatgccataaataaagatttccccgttttcgatgcggatgaatgcttccttgatgctgcactggcccatacgcagggactttacctctgtcccgtgcaggacaattccggcctcgtacttctccagtataaaatagtcatgatatgcttttttgttgttggcaatcagtctgccttccgtttttgccatggcactactccctctataaatcctctgcttcacagaattcaaaatcaatggttcgctgcaggcggtctgcatccagtaccctcacccgcaccttttgtcccagtttatataccttccgggtatgctctcccaccagttcatactgctcttcccggtaatcatagtggtcatcccgcatatttgtcacatggaccagtccttctattgtattctccagttctacataagcgccccattttgtaagccctgatatgacgccgtcgaactcttctccgattcggtccctcatatattccacttttttcagtttcactgtctcacgctccgcttcctctgcgcggcgttcgcattcgctggactgtctggccacttccggaagaatcgtattgtaatgctcttcccgctgcgcatccatcctgccccggatattctctttgataatccggtgaatctgcagatccggataccgccggatcggggaagtaaagtgggtataatattttgctgccaggccaaagtggccggtgttctcgggcgtatactttgcctgcttcatcgagcgcagagccagacggctgatcagcggctcctgcggcgttccttctacttttccaaggagtttctgaacctccttgggcctgatctcactgtttcccacatggatgtgataaccgaaattattgataaaagtactcagtttccggatcttttcttcatccggctgttcgtgggtacggtacaggaaaggcagctctctccagaaatactcttctgcaacggtttcgtttgccatcagcataaaatcttcgatgagctttgttgccacattccggtcatagggtttgatgtcgactggtttcccattttcatccaggatcatcttggtctccgggaaatcaaagtcaatagacccccgctttctgcgtttctcacgcagtacgcctgaaagttccgccatcagaagaaacatcggcacgagctccttgtatttgctgctttccccgccatctaatatggacgcttcctgctcctttagtatcttcgccacacttgtatagctcatgcgctcatcgacccggatcacagtctctgcgatctcgtgatcaactacttctccgttttcattgatggtcataatgcagctgagcgccagcctgttttctcctgcgttcagggaacagattccgttggacagcttatggggcagcatggggatgactctgtctgccagatagacgcttgtcccccgtttcaaggcctccctgtccagggcgcttttctcctgaacgtaattcgaaacatcggcgatgtggacgccaagccggtaaaaatccccttcttttgtaagggaaaccgcatcatccagatcctttgcatcttctccgtcaatggtcaccatctgccagccccgcagatccattctgccggccatatcagcctcgcttacttcttttcccacacgctctgcctgattcagcacccgctctgggaactccacgggcaggtcatatcctttcacaatggacataatatctgtccccgggtcattaatgtgtcctataatttcaacaacacggccctccggcttcatgtcctggccgccgtaggaggtcagttctaccaccaccttgtgtccggtcatggctcctttgtcttttccctcaggaatataaatatcattcaggacacgctggctgtccgggcgcacaaatccaaagcttttgcatttttcatacaggccgactactttcgtcgttccatgcgaaagaatacgcacaatcctgccttcttttcgctttccgtccgctccaagcctgctgtccgcttccttcgtgaccacgaactccacctgatcgccctggaacgcgcctccaatgttctcctcaggaataaagatatcctcttcttccccttcctgtatcacaaacccgaatccccgggcattggcctgaaatacaccggtcaggcgcctggcctctcccttcgtatattttccttttttggacacatggatctttccttcttcctccagtgagtccagcacttccttcagctcactgcgctgctctttggggatctgaaggacaatcgctatctccttgatcttcatcggtacatacatatcgtcacagataaaatcgtaaatgactttttttcttttttcaaaattctggttcatattctcaccttctttctattactttggaacttttctataaaacaaagtgggcaagtccactccaacttatatatcaaagtatgcaagcctctcactcatgagaggcttgcacactttggcgctgccgcgataccgccttgcggctatatactttatcgcggcgtgtgcatcccccggagggttattataatataggaaattccagcggaatttcctatattataataaaaaacactctatatctgtatagagtgttcaatcatcttatcttcttagttaaatacacccaggttcaaaaccagtgccaaaaccataaataaaatagcaaggaactttgtggactttacaagagcaccttccattgaacgtcccttattctgtccccagtaagtatcagccgccccgctgatcgtcccaagtccggccgactttccctcctgaagaaggataattgctgaaagagcaatacaatctattacaaatataattgttaatattattttcaaaatatccattcttttacacctcctgcggataaaccatgatcattttaccacaattggaaagattctgcaacaacttttctaaagttgaagccctgtcttaccctttacacttaatatggatatggatcagcattgcgatcttaaatacaattgcgtggtcaaagatacgcacatccagccccgtcagctttttaatcttttccagcctgtacatcagggtattcctgtgaataaagagcttccttgccgtctccgaaacattgagattattttcaaaaaagcattttacagtctccagcgtctcattttccaatgtgtcgaatccgccttttataaacacctcatccagatacacctcgcataagggaatcggcagctgatagatcaggcgcttgatccccagatgattataatctatgactgtcctgcttccctcaaacagatacagcagctccagaacataaagtgattccttatatgaatccgccagctgccggatgtcggtaacaatacttccgattccgataaccggggaggatttgaagatttccgccgcctttttctgaaatgtaatgccaattgtctccagctccgcatgagaagtattcgtttttgccttcacaataacaattatgtccgtttccgtcatagaaaatacttcgtatttctcggattcctctacgttctggatcagcatattcagattccactccgtatccacatgggaaaatctcagtaaaaatactgcccgtgccataatcgggggaatcttcagcatcttggcccttacatttatgtcagccgccagaatattttccagaaaaagcgctttgtaaaacaaatcccggctgtacttctcttcaaaataggatttcatgcccgtaaagcagacggatagtatcgttgcatagtcctctgcctccttatcggttccttcgacaaaaactgcaaaccgaacaaaactgttctcatagaagatacgatatgtattatttttaataaaaaagcatctgccttcctcgttcttctgcttcatcagattaaaggaattcgtggtccctatcatctcctgattgctgcatgaaacgatctccttattgtcaatcacgccaaacgttctgtatatacttttttgtaactgatatatatatccctggaagaacctgtctgccatctttccacaccgccttcaattattcagactagagcgtgtctgaaaattcattatcgcaatatgccactctgcttcacagtctagtgcaaattattataacacatatttttacgccggcaaagcccacggaagcagttttcactaccttccaatgggcttttctttacattattctatgtatcctctctccatcaggtattcttcacttgcgcctgcggcaacccaccatagctttttatttttccgaaatgaaagatagatagccagatataccacaacaacgataataatcccaactatccgcatcataccgtctgccgaaaatgctttgtataccagatataataccggattcgtacctaccgtccatgaggcaattccaagcccctgggcaaaggcattggaaacagagtccatctgtgaagctacacctgcggattccgcagcctttgtaaacgcggcgcagacatccgaattcagcacatttgccacattgaaccagactgccccggagaccacagtcatcagaatatctccccggaatacgcagatcagccccgccgtcataaatgccatggccggaatatctgcaagcatcagaatcttattccccggcaaaataatggatataaagaatacgatcggaatcaggatcagcgctgctgccatattatccccgtttccaaagaaaactgccggatccatggcaatatgaaaatactttctattcgagctgccggaacgtgcacgtgcctgcatggactgactcaatggaatcagtcctttcacaaaaagtccggaaactgagggataaataaccataaccgccgcaatggtaattgacgctgtcaggattccggcccatgtatttacatttgccagaccggtgattgaacccaaaatcgttatcaacagccctactaccaggccgatggaaagaggttctccccaaaatcccaatttttcctgcagccgctccgcactgaccggttttgttttaatctttaattttaacatgatccatcttacaatcatggcaaatggcgctcctccggagggaacactggtaagtgtaaggttgtcataaccgttaaattcctgcagagacggtgcgataatatctgcgatcagaagtaccaccaggttgcacataaccgccgctgcaacacccagtgcaaaacttcctgtcgtaaactgcacgataactgcccagaatacaaactgatagtagttccatatatccgtaggctgaaacgtatcgaccaatttcagcgcgaacagaagcagattcagcccaagtccgagcaccagataaatataacccagcgtattggagtacacgacaacggatgcgccctgccagccgatatcaatgaatggcagctgaatacccacgtgatccgccatggcagttacatatggggtaatagctgtcatcagaacaccgagcacggcgttgaacaaagtcagcccgaccgccatatagattgccccctgaaaagatttctttaccccaacacgcataaacatactaatgatgaatataactactggtacgattatggtgctcccaaatatgcccataatattattaacagcatttcctatttgtaacaaagcctgcatttttctacctcccgatatttagtagaatgtaggataaatactattcatccatgatttttttaactgcttccagcagctcttccgtaaactgctccgctcccactcccgtaaacagaggcagtcccagtaacaccggagcgcctgccttgttctttgcatttgtctttcccgtcactacgatcagatcatatccctccagattggggacttccgtaattttatgagggttaattgaaaatcgtattttttccttttttaatatatctttgatcttatccgttacaaccgttgttgtaaaaattccgccgccacaggcaaccgctatattaatttttgctttcataatcattcactccattatttaaattatcagatattcctctaacaattccttcattttctgtatcattgcttccggtttgtcaatttcaagcagttcgttcataatgccgtcgtcctgaaaaatattgctgaacttcctcaaaactgctgtctgatagcttgggtcagtaatgccgaacaggaatacaagtctggtttccaccgtttcatccggatcccccatacatccaaatacaaccgatgtgtccagaacggccatcgagaaaaaggatctcaggcagccgtcgtgaatgtgagggatagcgatgggaacgcctgtgggaagcccggtcggatactctttttccctttccagcagggctgtaataaatacaggctcaatacatttcatctgcatagccctatcgcacagtcttctcattatgtcctcggcatttctggcttttatccctgtcagtatcatttccttgtttgtataaaggcctattgcttccatccaatctctccttctcagtcttcgccaaacttggttttaatcagtgccgccagtgcttccactgcttccttctcatcttcgccctcggcgcttatttccgctgttacaccctttccaaggccctgtgcaatcagcatgacaattgactttgcattcgccttgcagctgtcttcctcatccatattttgtataaagattttactccgaaatttgtttgcaagtgatatgaaatctgaagccggacgggcatgcaggccagtctcattctcaatcactacctgttttgcatacataagttctcctcctttacctgcctttaatccggcagttcactttttatgtattcttccacctggactgctgtagaaagttccagcactgttctggccattctctcggctttgcagatatcaatctgagagatcattttcttcacggaggccagggaggaagcattcatactgaacttgcgcactccaagtcccgccagcagcgctaccgcctggggatttcctcccatctcgccgcatacactgaccggcttcttctgtttcccgaactcttccacaatctgcctgatcagccggaacatagcgggatgaaaactctgataatatttcgcaacacttggattgagacggtcaactgccatgagatactggcagagatcatttgtccctatacttgcaaaatcgacctcagacgctgcaatatcggccataagcgcgattgacggtatctctatcataatacctacttttacatctgtgcgacaggagatattttcctcctgcagttcttcctttacttcttccacaatctgcttggcaaaccggatatccccaatgctcccaaccatagggaacatgatccataggtttccgtacacagcagcccgcagaagtgctctgagctgcgttttaaatataggtttcatctcgaaacaaagccgcagtgcacgcagccccagaaatggattgtcttcccgcggaagctccagataatccagcttcttatcgcctccgatatccagcgtgcggataattaccggccgttctccgtacatggtcacgatctttctgtaaactctgaactgttcctcctcttctggaagcgcctttttgctcatatacaaaaactctgtccgaaacagtccaaccccatctgtgtatgattccagctccagttcactcttgtcggcagaaccaatattcagacagacctcgattcttgttttatccagcgtctcaggaacaaagggcaggtactggcgcatatcgcttatctttttcagatatacctcgcgcataacctgatactgcttttcctgatcaaccgtcagatgagtgattaccttcccatccttcgcatctacagctatcttctggccgttttctgtatttttcataatatctgccacacccagaaccgctggtattccatagtttctggccaggatcgccatatgtgaagtatagccccccacttccgtaacaatggccttcacatattctgtcttcattgctgccgtatccgaaggaagcagatcccgtgcaaccacaattacctctccggacaacgaggaaagcgggttttcatgtccgccgtcccacaggcggatcaaccgctgacagacatcttttaggtccgctgctctttctcggatcagagcatcctttgccttggatataatcttaatatatctttcataaacttcctggattgcccattggggagacagcagattgtcccggatttcgtcctcgatttcgcggctcatctcttcatcctgtacaatatcaatatgtgcctggaaaattttcctttcttcctcgtccagctcagaaccttcgatcagctgttttaattcttcttccgcctggatgagtacgcctttatacttttccatacagctgtctgcttgggcttttgcaatcgtctcatggcggatttccggctgataaggctcatattgaaacacacgacctatggctgccccatccgaaaccgccgttccttcataaatcattctataccctctttttcgcttacctggttttgcatcgcacgtacttctctatggcgtatgcgacgccgctttcattattcgttaatgtcacttttccggctgcctgttttacaccttccatggcaccctgcatggcaatcgaaaggccggcatactccagcatgcttttatcgttttcaccgtcacctatagccaccatctctccgggctctatatgataataagaaccgatccatgccagcgcacggcctttatcgctgccgccgagctcaagagaaaaatcatacgcacgatccgcactcaccacgccgccaaaggctgtggacacccattctctgaactgcgtaactctgcagggttcatccaatattaaaatctttcccaggggtgtgttattatagcacatcccgatatcctctgtatagacaaccctctgtcccatacatgtttcaaatatctccagatatgttcccttaagcccggaatagacctggtctttctggtaaataagcggctggtagagatgcgccctgcagtaatccagtattttcctgcagttttcggatgaaatcaactccgcatgcaggattttattcccggtatagtccagtaccaggctcccgttctgcgtcacgactgcatcttccagcttaagtgtttcaataatccctttaagcgccggatatccccttccggaaaaaggaatgactttcaccccctctttcctgatatctccgatagcccttcggttattttccgacaacctgtgcttatcatccagcagtgttccgtccacgtcaactgctaataatttatatttcacgttacctcctgcgctgcccgctgcttctaagttagttctcagggcagaaaacatcctgtggacttttctatttctttaaatcaaataactgctggttcatgccttcaccccaaagatcaagggcaacctttaaggattcacagtctttcgcagcttcacgaagtgaaattccttctgccgttgcatctgcagctttgattaagctctcaactcctgcggctgctcccattggatgcgcgtgcattgccgcacctgctgaaatggagaagtccattccaagatcggatgcaacatccgggatcagtccctgatatacacctgcagccggtcccgggaacgtgcgtttcattcccctgaaatctgtcagcagagcctgtgcaatcctgatataccgctcacgctgaatgtctactttgccgtatgcacaaggataaatcacgatatcggctccgctcattctcatgaatttgcccagaatcaaatggcttgatacacctgagtagtgtgattcgtacatcgcccctgcaaaagccggatgcgccaggatcggaagcccgacttcatcgttctctgctaccatctgcatggcaggccagcctacagtgagtgcgttgatcatgattccgggaatgcccatctctttgcacattttcgctttatcaagcatcttatccggtctgtctgtgatattaggtgaatagatcacgcgttttcctgttctctcatagacatccttcaaaatttccgcagcaatcttagctcttgcttttactgtacaatattctgtatcgctgaagagttcatcgtctttgatccagtcgattcccgccattgccagttcccgtatcagtttgcctgcgttctccggcgttgcccctgtacacggcttaatcatgctgacaataaaaggccttttttcaacacctgtcaactctctgaggccctccacgccatatctcggccctttaaaagaatccgtaaatactttcgggaagtcaatatcaatcagtttgagttttcctgccatagaaatatttcctattacagaggtcagtacctgtggaaggttcgggcccatattctcaaacgggaatgcaatctggaatactgccatacgctctttgccttccatctccggcatattgaactcatagcacggaatctcgtgcactgcgattactttgccgccgtgtcttctcctgacttccggcgtctcaaggggtaccggcgcccatgtgccggtagtctgctcaattgctatagatcccactttgttcagcagatctgatgtataaccttcacaaaagtaggtgcagataatatgggtgtccttgtctactgactctggtaatttaaaaatattcggatcatattttgcattcatgataaatttctcctttcactctataacgcccgtgctacatattctgtaatatcaatgatctccatgtctttttcttgaacagcctcttttaacgcatgtttttcaaacacgcatcccgtcactactgtcctgcatcccagatccgcaagctcctttgcccgcttcttgctgactgctgccgccagttccggataaaaaagacccagaccgccgccgaggccactggaagacgtccggtatccagttctctgcggctgtactgctttttgaccgctcagtttgaaaatcaattcttcggtagcttttatcccgttttttctggtaagcatatgtgctgcgtgataggctgcctgctctgtaacccctgtggcttctaattttttcttctccaaaagatcctccagaaattcgcttgtatgcagatatgtatacttctccggataataattctgaaaagcctcgaacgaataactgcacggtgtaacgatcacttttgcctgtactctctcaaatgcttttacattggtatccacagccttttgcagttcctctgtctgtccgcttctgtccagaaaatatccactgtctgcagtgtcggtcagaaaagtataggaaattcctgccgccttgcagatcttatcaaaggcattctgcatctccacatccaattctcctgcgtatccaaggaatacggcaacatctgctttgccttcccggatctcctgcggtttgccaagtatattctccccggcctctgccctgtgcacaatatcggttacagcttccggcacggtattcttctctctgcataagcggcggatatatgccattgtatctgcgatcggaacatttacgggacatgctgattcacattcatagcagtcaatgcactgaaatgcttcctccgtcaccatttccagatcaaaacgggatcccagcgccgagtatacagcggaatacatgggggctttatccgttccgaccgccctgacagccggacatcggtccagacacaggttgcatcgcacacattccacgctgttataataaatatcattaaagtctttcatcagtgctcacttcctttcgccatatttgccgcgttctttcctgcaaggtatccggaagctgccgcgactcctgcaccgcttctctcatagacccagtcatagccttccattaaatccccacaggcaaatatctggccggaaaagctgccctgtgctatggtcatattatcgtacacccggatgccggtcttgatgaaaggctggccgcctccggggaatacttttttatttatcatatcagcggcaatcctgcccagcggctcatgaataaccggaataaacatatcttctctatatgaggtgataccgcctccgatgaaccctccggcagcaagcacaatctttcttgcatatacttccctggtctttccctgctgctcgaacacgacacaaaataccccttcttctgttttcttgatttccactgcctttgcctgattggttaccttaatattcagattctccaggcctttttcaaatgcgtccgcaagtctctgtgcactgaccgaatgtccgcctgcagagatctctcccaccgggatcccaagtgtttcaaacaagagttccatgttctgtgcataattttgatagcccagaaccggtggaaccagaatcctctgaataccgcccataacgttcttcatatcatgaagtactgctgcaagctcctcaatgccttcgctggtatcaaaaaatgcggcaagttctgcattagtcaacttctccctgtttgtaagagaggggagttccaaagtgactgcaatataagcagcatctgccttgggagcaaactgtttctgataggcattgtaggacttgcaggcatattcgggataaaattccgtatatcccctgaaccctgcaaccagtattttcccctgggctattgtcacgtctgcgtatttattataggaagggatgtatgccgtatttttataggttcccagaatattcgggatggcggcgttcctgatcccgtcgcctgtaaactccattccgcctgcgcggcagacttcccgcaatgctttaattccattttccagactgtctttaagaaccgcataggggtgctttggatttttctccagcagcaggttcatgccctcactgatttcttctacaactatatttttctcttctcccggcaccgctcccaggatatccagaacgcccgagcccatcatggttgccccggcgccttttgtgataatttctacgccggcctgctcatccgctgccgcctttgctgcagttaccccagccatgccgctgccgattacaattacatcttttatcttatcattcatgcggaatcacctccgttggtttggtatccagaagatcgtagctgccctgggttacataaaatgcctgcataatttctgcctgtgccagttgatctccatattggagcgtataataaatgcccttccagcgctcctgcatgtactctgccagctggtcatgagcctcctgtgccgtcgcttgaaccgctttctggtacagggcagccactttatatgtacagaacgttccctggcaggttcccatgccgttgcggattcttcttctaagatccttaatgttaaatacttcctcattctggaatgcattaatgacttctgatccgattacctgggcgcattcacatatgactccggcgtactccggcgcagcatctacaatttcctttgccctgctgccatatcttgcggtcatcttatgtgcactgtacaacggtactttgtatttcttatgtatatattttgcatctttttctgcgtcttcttttgtctgggccccatagatcagccgcttatgtgtcgtacattctgcatcgcttcccagctttctgcatacaagatctactgtctcttccgccatcagccttgccgttgcatattttccgcctgtgattgtgacaattccttcaataccatgttcttctgcgtgatcgatcaaaatcattctgcggctgaccgccctcccggtttctgatgtggttgagtaaaggggtctgacccctgtgcacatacggagcattcttgcatttctgatatccggaatgatctgctctacactgctttccatcagttcaatctcgtccagccccggaaccgccgcatcgggatcctctatatctacggaagatgtaccaagcagggaagtattctgatatcccatgctgacaaggccgtcgccgtctgagggtactctcagaataccaatcagcgttttcgtgggccgcatgttatagacccccatggttcctttatttggctttacaggtatcttaaagccggccatttctgtcactctggagccccaggggcctgcagcatttaccacaatctttgcgcaaatctcatagatcgttccattctttctgtccagtacctttaccccttttacggtatccgcctccatgatcagatctattacttcgctgtgcgtccggatgactgcgccttttacctttgcatcatatgcctgtgcaatacagagacggaagggatcaaatcccgtgtcaattgtacgcagggcgaactggatatcatcggccagaagaggttcatcctgtacggcttcctccggtgtgattacttcatagggcaggccaatctcatctgcattctccatccacttctttgcaaattcaagctgctcttctgtctttgccacccacattgcatctgtcgggtcgactacctgtgggactatctcacggaatactttgttctcctgcagacattccactgcagtctgcttatctgttacaacatatctggaaccgccgtgcagcgctgaatggcatcctccggatgtacccgcagccagatcgtctctttccaaaagaacagaatttgtatatccgcggagtaccaaatctcgaatcgcagctgttcctgtggtcccgccaccaattactactacgtcaaaattttctcgcataaattcgatctcacttcctattttctattttcaacccggtttgaattagacttataatatcaccgtttatttgcacaatcaaatccggtttctttgcacttttttcgtttttttgtcctttatttgtgcatccttttcaatttccgttccatgttttagggcactttgtacacgccaccataatttcaactttgtatagcacaaaataattttgtcattctgcaccattcctaccacttcattttctaactgaatataatagagtttttatgatataggaaattccggagtaatttcctatatcataaaaaagagcctgtccgggcttctttttcaagtcccggacaagccccttttcaggcatacatccttctcctttattctcccataattttaatgcagatttttttcatgcgcttgccgttaaaatcagcataaaagatctgttcccagtgtcccagatccatatccccttccgtaactgatatgagctcgcttcttccgattatattccttttcagatgggcgggcgcatccttatcactcttattatgccaataatagggggccttctgttcgggaataatctgctctaaaaactccagagtatctctgatcagtccctcctcatcatcatttataaaaattgatgaggtggtatgcagagaagatacggtaataacaccttctctaatgccgctctcttccaaaaccatcctgacatggttcgtgatattttttatcgtttccttttcttcaaattcaaagcttagatatgtacggtatgatttcaaaataacccttcctcttctgctgccagcattcgtctgaccgccctcaaaacagcctgttcactcaggccaatgcgcagaactggtatacaggcgcagtctaagttcaaacacactctggtactatttatatgtctgttttattataataccgtagtattcgccaagtcaagaagacgtataaagctgtacaccacagactgcaaactctgttttcataaattatttttaaattttatttcctgcagataaaaacagctgcggttgtcatttccgtcaaaaccacagctgtttttcttatctttttaactatcttcccagctcttcctctatcctgagcagctggttgtacttagcaacacgctctgacctgcatggagccccggtcttaatctgtcccgtgttaaatgccaccgcaatatctgctatagtcgtgtcttccgtttctcctgatctgtgggatatgatcgcattatagcccgccttctgggccatctcaatggcatcaatcgcctctgtcagtgtcccgatctggtttacttttacaagtatggcgttagccgcattctgctcaattccttttttcagccgttcaacattcgtaacaaacaagtcatctcccaccagctgaatctcattccccagtcttgttgtcaaaagttcccatccgtcccagtcttcttcatccagcggatcttcaatagatcggatcggaaattccagtgataagtcttcgtaatactcaatcagttcctcggcagagcgcacgatcttctgtccctgcatcctgctttctcccgggaattcgtattttctgaaatccttattatacaattctgatgctgcaacatccagtgcgatctgaatgtcctttcccatctcatatccagccttctccaccgcctctttcagaaatctgagcgcttcctttgcatccggcagatcaggggcaaaaccgccctcatcacccacggccgtgctcagtccattttctttcaataaggctttgagtgtatgatagatttctgcacacatgcggagcccttctttaaagctgggcgcgccaaccggcatgatcataaactcctggatatccagtgtattgtccgcatgcgccccgccgttcaggatattcatcatcggaaccggaagttcgtgggcattgactcctcccaaatatcggaacaagggtactttcagagcgtttgccgccgccttggccgctgcaagcgacactcccagaagggcatttgctcccaggttctttttatttttgctgccgtcagccttgatcagcacttcatcaagagctgcctgatcaaatacattcatgccgatcacggctcttgcaagctggtcattcacatgttccgcagcgcgctggacaccttttccgccgtagcggtcttctccgtcacgcagctccactgcctcatattttcctgtagatgctccagagggtaccgctgcgcgtcctactgtatcctcccctacgagcacctctacttcaatcgtcggattgcctcgggaatctataatttctcttgcgtatacgtctcgaattggtaaatactgatacatataatccttcctccttatgggaacatagtatttccaaatatcttgtcttaatgcgttgacttttcatattccgggcgttacaattcggatagagtgagaggctgttaatttcaaaattatgtacattacggggagcatacagatgaagggtaaactgaagcattttctattattgacaagcagtacactgattatggctgtcggtacttactttttcaaatttactaataattttacattcggaggtatcacgggcctggcggttctagtagccaagaccggattcatgtctgccagtgattttacctttgtcatgaatatgatactgctggtcataggatttattgtgttaggccgtaagttcgcggctaagactgcctactgcagtatcctgctttctgtaacgttatccgttctggagcgtgtttatccgatcacccacccgctgacagaccagcccatgctggagctctgttttgccattgcactgccttctctgggttctgctgtattgtttaacatcgggtcatccagcggcggtacggatatcattgccatgatactgagaaaatattccagttttgatattggacgcgcgctgctcatcaccgatatccttattaccatcgcaggctgctttatgttcgatataaagacagggctttattccttccttggcctggcaatccgctcattcatgatcgatacgtttatcgaaagttttaacctctccaagtatttcaatgtcgtatgcgatgaaccggaacccatctgtgatttcattgtaaatactctgcaccgcagtgccaccgtctgccatgcacagggcgctttttcgggcagagacaagtatatcgtgtttacggcccttaaccgtccccaggcagtaaagcttcgtaactttattaagggaaatcagccggaagcatttattctgatttcgaatacaagtgaaatcatcggaaaaggatttcataatatatagtacccaaaaagttcaataaaaggagacttcaatgaaacatcttgtgattgccgaaaaaccttctgtggccagggatatcgccagagtcctgcgctgtacaaagaagacaaactcttatatagaaggaaatgaatatatcgttacctgggcgctgggacatctcgtcaccctggcagatcccgaacaatatggcgagcagtataaaacctggaacatggacacactccccatgatccctaaagaatggaaactggtggtcatcaaacagaccggaaaacaatttcatgcggtcaaagagctgatttaccgcaaggacgtatccgatatcatcattgcaaccgatgccggacgcgaaggcgagctggttgcccgctggattctggacaaagcgggaagcaaaaagccactgcagcgtctctggatttcatctgtaacagataaagctatccgggaaggttttgcgaacctgaaaccagggaaagcttattacaacctttacagagccgctattgccagggcgcagtccgactgggtggtgggcatcaatgctacgcgggcgctgacctgtaaatataacgcacagctctcctgtggacgcgtacagacgcctacgctagccatgatcgctgcacgcgaagaagaaatccgcagttttaagccacagcctttttatgggatgaaagcatctgccggaggaatcacgtttctgtggtgcgacagccaggccggctcttcaaggacatttgaccaggaacggattcaaaagctttataagcagtgcggcggtgcacttgagattacagaggtcataaaaaaggataaaaaatccttctctcctgcgctctacgatctgacaacactgcagagcgaagcgaaccagcgttttggtttttcggcaaaggagaccttaaacatcatgcagcgcctgtacgaaaaccacaaggtactgacctacccaaggacggactcccgctatctcacttccgatatgacggtaacactaaaagaacgcctcaaggcctgtgcagtcggcccttacagtaagattgcaggtcggctgaccatgcagcccattaaggccaataaatcttttgtggacaatgctaaagtcacagaccatcacgccattattcctacagaacagtttgtacagctggatcatatgacaaacgaggagcgaaaaatatacgatatggttgtgcggcgtttcctggccgttttatccccggcatgcgaatatgaagaaacctcactaaaaggcaggatttcccaggaggtgtttacggccaaaggaaatgtgatcagacaggccggctggaaggaagtatatgaggctggcttcgaagatacagatgaggaagaagcggaagaaatttacatcaaacaaactctgccgaaagtacacaagggacagaaactgcaagtaagcagcctgaacataacagaaggaaaaacaaaacctcccgcatatttcacagaaggcacactgatcgccgctatggagaatccggtcaaatatatgcagcataaggataagacgctgatcaaaacactgggcgagaccggaggtctcggaaccgttgcaacacgcgcggatatcatcgacaaactgttcaacagttttctgatggaaaaacgtggcaatgagatccatatcacagccaagggcaggcagctcctggagctggtacccggagatttaaaaagcccggaactgaccgctgactgggaactccgtcttcaggcaatcgccaagggcaaggaaacagaccggcactttatggatgagattgagcattacacacaggctttgatccaggagattaaaaccggggacggaaaattccggcatgataacctgacccgtactaagtgcccggaatgtggaaaatatatgctggaggtcaatggcaaacacggcaagatgctggtctgccaggacagagaatgcggacatcgtgagaccatttcccgccgcaccaatgcccgctgcccggtctgccacaagaaaatggagctggttggcaagggggatggacagcggtttgtctgctcctgcgggcataaggaaaaactaagtgcgttcgaagccagacgggcaaaagaaggcaagggggcaagtaagaaagacgtgaataactatttgaaaaagcaggccagggaagtgaaggaaccggtgaataacgctttcgcggatgcattttcaaagctggatattcatttatagtgcccatttttataggcaactgatccggctgcactataccggtgtatggatttttgacttacgccaaattgtttattgacattataaattatgaagtatgattataattaaagaatgctgcgagatagatagtagtcctcgaaaataagtaacttactgttatttattattcgatgtactactatctatcctgcagcattttaaaatgtatttaaattattacataaacttttctttcctaatggaagaaatgatccccgatctggattccataatctccattcccaaagtaaaggcagtccccgattggattagatccggcaattgcgtctgctgccgcctgcatagcagtatcggtgtaccccccgctcgccagcacgctgtccagccagcccgtcatagccggcccaaactgtcccgactggtaaataacctctgaaacgctgttcggatataccccgctgcgtacccggttcataataacggctcccacggcaacctgtccttcataaggctgatttcccgcctcacagaaaataattgctgccagcagttcctggtctcccgctgccacgggctgtgccacagccgctgacgctgctgccgcctcggcttcctcagccgcacgggcctcttcttcagccgcacgctgagcctcttcagcggcgagcctttcttcttcctctttccgctttttctcttccgctatctttttctgttcctcctcataagcagcttttgcttcctttgctgctttctttatctctgctgtttgctctaccggaatgctttttacggtctctaacagtaatgtatctccttcctgtttatctgctgtatcaattgtaactgccacaggcatctgtgaagccgcctgtgtagtaaagccagctgtgaatgtcatacacaccgtcactgctgacaatactgttataaattttttaccctgtaacatatacttgacctcctgatttgttgcaatatctttaagtattcttaataagcttgtaataaaatatatgcttttaatttcaaacttattacagatattacaaatttgttacaaaagtcattctaatacaaaaaatgaaatctgtcaacttttttatttcttccacaatcaggtaaaattgggaggaggattttctggtggagggacgcctgtctaaaatacggtgagggatgccgccgggaagcaggggaggggggctgaaagcagcccgttgcggagtcgcatatttttcttttaaccacgcttatccgcatagccattataaatacgccgcccccgccagcgcctcctccggaatatggaatgtttcttacgactgggtaaagcccagctgtgcggaatcgtgacaggactcttttggatgcgtcttttgtggtgtaacagccgcttcatcaaaatgaaagccaacatatgaattgaaagcagggcctccagccctgctttcaagccgacttatacgggaatgcatcctgcattcccgtgtttgtcggcggtattcatcatgttggcttttattttgattagcggctgttacaccacaattccgcatccaaaagagtcctgtcacgattccgcacagcgacccttagccatctccctaaacatttcaatttccagcagctcgttcatattcaggattactgcgtctgcgcctgcatccatgaatctgctggttactgcctctgctctatcttttttttctgcctccggcagtgcgttgtattcagattctgtcaggcccatttctgagctgccttctactactcctatggtatagacgcctgcattttttccttctttgatgtcagatatggtgtctcctaccttgatgacatgatctatggattttactctgagaacttccatgtttttgaagatcatatacgggtaggggcgccctgcatttccgacggaattggggctgaaccatgcatccggttcatatcctgcctctctggctttttgcacgacgatctgcatcatttcgtctgtatagcctgtagtggagcctattttgattcccagttcacgcagcctggctgtagtttccagtacgtgtggcttgggatcggcaaattcatccagtattcccagtaatttatcttcaaaggacgcatataattgatcgatatccgcctctgatggggatttttcgtacttcttttcccataatccacggattcttggcatttccagcattgttttaatatgatctcttttcagcattcccattggctctcttacctcgtccattgtgggctcaattcctgcctgtctgaatacctcggcaaatgcttttaccggtgcaaaacagccgtaatctaccgttgttcccgcccagtcaaatataactgcctctatatttttattcatggctgctctccctcagaaattccgttataatctccatcagtttcaaaatgtcgtctctgtatatctctccgatattaccgatacggaatgtatccgcctctgttacctttccgggataaattgcatatccgcggtctttgatgtatgtatacatttctgtaaaagaaaacgtgtggttctccggatagcagaaagttgtgatgattggcccctgatgttccgcttctatatacggatggattccaagctccgccatcttttcaatcagaagcctgttattctcggtataacgcctgcttcttgccgggatccctccttcttcctccatttccttcagtgcttgtgaaaatgccagaaccacatgtgttggggaggtaaagcgccactttccgtctttgttcattgtctcccactggtcgtataaatccagtgaaaggcttctcgctttccctttgcttgcgatcagtttttctctgtctgcaatgataaatgagaatcccggcactccctgaatgcatttgttcgcactgctgattataaagtcgattccccactcgcctacaggaatatccactcctccaaaactgctcattgcatccactatcatcgtacggttccttgctttcacagccttagcgactgcttcaatatcattgaggatgccggaagttgtctcactgtgaaccatggatacgtgggtaatggatggatcgttgtcgagaatatctgcaatcttctgcgcatccggtactttatagtaaacttcattgtacacaacgtgacaaataccagcatgcgctgcgatatccgccattcgttcgccgtaagcgccattggcaataattaacagcttatcatcatttgctatcacactggtcaaaaccgcttccacgccaaaagttccgctcccctgcatcaggacaaccgtatactcctcctcagaaacatgtgccagctccagaagctttttccgaatatcctgtgtaattgatttataatcatcatcccaggtgcagtgatcgaacagcatttctttctttacactgtctgtggtcgtcagcggacccggagtcagcaatttgtaattcttcattttataaatctcctctcaatctttgtatcttctatcagtaaaaatccagactacggaaattatagcagtctgttttttaataaacaatcaaatagaattcaagattttgtaagaaatttgtaaaatcgtaattgtaaaacaattctgaaaacggtaggcaaaggggtcagacccctttgcctaccgtttctattctctccgttttccagtcagttcttttgccgttattttaataactgacacaattgtgacaagccgctcggtaaattcaaagtcttttcccgtctggcatttcattagtatactcaatgcctccatcttctcctgcggctcttccacaaactcggccacaccttttcccaccaggctggcgtatcggaatccatactggcatgggactcttccttctatcagttcatggtcacagtccagttcaaatcccacattaggattttttcttagcagatccagctttttgccctctagtgctgcatggatataaattaccaggttattgtcttcgtatgtatatccaaaattcatgggcagcatataaatcccatcttcatcatacatggccagatgtacgaccttacatgtatccaatacatggagtatctcttcccggctctcaatttcacggtctcttcttctcattcgcggcattatgtttaccctctctttcatcaaatatattttatcataccataaactatagtagtctgcactcaatattcatgcgtaaagagctccaaggccctatcgacagcagatgtatttcatgatatagtatcgttgttaagttgggaaacatgacatatacataagaaaaatgagtgaggtttttatgaagcggggcagtcaaactacgaatcaaatcacggagggtgtcatctggagacagcttcttcttttcttttttccgattgtattcggtacatttttccagcagctgtacaacaccattgacaccgtaatcgtggggcattttgtggggaaagaggctctggccagcgtgggcgggtcttccgcacagattattgccctgatcgtgggctttttcactggactttcctccggtgcttctgttgtaatcgcacagtttttcggagcacaggatgaacgttctgtgaggcagagcctgcatacggcctatgctttctcaatcatgggaagtattataatcagtattctcggcattgtacttgctccgtccatgctgtcctggatgcacacccctgccgaaatcatggctgattctattctgtatctgcgcatctactttgcgggcattctcttcgtctttatttttaatatgggctccagcatcctgcgcgcggttggggactccagacaccctttgtattacctgattatctgctgttttctgaatatcgtactggatgcagcctttgtagtcatcttccgcatgggtgtactgggtgtggcgctggccaccttcctttcccaggctttcagcgccgctcttgtcacgcataaactgatgaaagcggaaggcatcctccggcttttcctccgccggatccgtttccacggctctgtaatgaaatcacagctccgcatcggaatccccgccggtgttgaggccgttatgtacagcattaccaacgtcatcattcaggctgctttgaacggtttcggcaccgatactgctgcggcctggtctgtatttggaaaattagatgctgttttctggatggttagcagcgcattcggtatctccatcaccacatttgtggggcagaattacggagctcgtaagaatggccggatccggaaaatcacctgcgtcagcctgggcatagattttttggtctccgcggccctcgtcgtctttctgattgcggcacgggttcccttgttccggctgttcaccacggataccgaagttatacggatcggtacagaaatgcttttgcaggtgactccgtggtatattaccttcgtattcattgagatcctctccggttctctgcgcggcatcggggatgtaatcattcctatgatcatcaccctgtgcggagtctgccttctaagggttctctggatcgtcggcgccctcaaaatccagcccaccatatcggcaattatattcagttatccgattacgtggattatgacttctatattatttatctgctattacttctatagaataaagaagatgaaaatataaacacaaagggggttcagaataaaagttcaggcctgtcagaattattacgattcagcagattggcggtatatagccaagctgaattgccttagtgactgcttccacaacagaggaaacctccagcttttcaaaaatatgctgcaaatggttcgaaagcgttctttcactgataaacagctcatctgcggcacattttcgtttttttccgctgctcatgatctgcagtatcttccgctccatccccgttaaatcctcgatgatcaggccgcctctttcctcaggaaaacaggctgcacccccaaaaacgcggattaaggacgcgaccaaatcatcgggactgatatttttattcagaaatccgttgattccattctttttcgcctcatgcctgtacacaggcaggtcgtaccccgttagtatcactatttttacccctggatttgattttctcaggtgtgccgcggtctccagaccatccgtatcgctaagggtgccgaggttgatatccatcaggacgatgtcaatattccgctcccggacgatcttatccagcccgtcaatatcctgggtcgaataaaaatgtttgatctccttatactcatccaaggccacggaaaggctttttacaaataataaatgatcatcaactaacaaaatattgataagaaccctctcctttcatcggaatcctaatgtgtatgcagatcccctgcggggcgttgtctgaaatctgcatcgtgccttccatataatttacctgctctgcggcagaagcgatccctttatgcttccctttgtctgcagaaattaatgagtctgcatgggcgcttccattatcactgatatgaagttcgatcatactattttcctgtataagcgttatccaggcctgattcccgtccgagtgcttgtaaacattggccagcagttctttcagcagacgatagaccagtaattgataaggctccaccagaaataaagtatcgtcacacgcaaaggataccgcaatattccgctgcggaaaagtctgagaaacatcctctatcagattttgatagttctctttagcggtcaggtttttcagtaaaacgggatgataatcctgcatctgctcccgtatatggatattcagcttatccagcgtttcgatgataagctcccgtacttcgggccggtgtgcctttgtcgtcatattttttatggaaagcagatcctgcagcacatcattatgaagaaaattcgcgaactctgttttcagcagttcctcttgcctaagctgacggagggcagcattgtatttgctctccttggccatcttactttcaccttgttttaaattccttcccaaaatgatattacacatatataggataacaaacaaaacattcactgcaatcatcagttcttcatacccccagcctgcagacagagtgatcagaacaaacaaagacagggacatacctaagattcccagaacctgtataccgctaaatacggttgaaatcgggtaactgctatgctcctttcgtataatcccgtggacactgataaagaatagaagcatagggagatatattccaaaatttgaaatatggtttttaatatctaccgttgtaatgaaataaatgaaaaacgatatcccaataactgcagcagaaaacaggatacatttccattcgctttttaacacaaacacagcccgtttccaatgaacgatgatgataaacaaacagcagagcccgctcgccaaaaactgcagcccatacaaacctgcatagatcctgtccggcatgcagataccggcgatcgaaccgatacaggttcccagcagtatcacatcgaccggctttcggaatcggtaaccgcttccctggaacagaaacatcaggaaaaatttaacggaaacgagacatataatcgggcttaaggcgttgtaaacaaagctctccaccatattttcttcaaaggaaagaagtacataccagccgtccatggcaagcaggccgcagaagagggagagaactttattttctttgatattacaggcactgatataagtcatatctatcagcagcagcgaggagagcagtaatgggattctgctctccagctctgtctgtctctcgttcaaatgccagctcatatagaggataagcagaatatagtttaccaaaaatatccgctgcaataccgtattcttcatctttgccctcctttgtttttctcattataacatggtccccgccatttctacgaaattatttaatacaggctaaccgaaagcaggtacggacagtaacaaagtaataaatcaaataaataagcgctgtcactaccacggcaattacaactggaacaaattgaatcagggtgtcgccaagcagattttgcattaaccctgtcttatatactgctgtcgcaaaaatacagtctaacaggccaagaccaaatggaatactaaaaaaggccagcacctgtttcctgataatcttttttataaacctgcccgtataccccattttaatcagaatgtcatagtcggattttgtatcggcaacagcagcgatattgttaaaatacaagatacttccggccgcgataaagaacagaatcacaagaaaaccaatcagaaggaacgtggagctgtttagggaaaacagttcgtttaccctatgtgaatgcccctgtaaataggggcttcctccaagtaaactgctgatttctccgtacaatgcttcgttatcttctatcgctttcccattcacacttatcactttagccattggttcatcagccgctctgatccggtcatacatttcgtcgctcacaatcaaggttccaatactatttgcgaacgacaatggattatcaagcgttaccttttttaccgtcagaggtgcctcctcccctcctattattaacggataacttttcccagcctccgaactgcccccgcctccaggctgatactttactaaaatacactcctcatccgtcagtccgggcaaggaatcgatcaccccctccctgccctgtgcacgcagcaatgttacatagtctgtgaatgagatacattcaaagcctggctcccgtacaatcttttcattttgggcatcaccttttgcagaaccgacgccatattccacaggtagcacggaagcagaagaagccgccttatagatctctgtctgcgtaaatgtaattgtttcgtccggtgcatacctactgacaatccgcttgacattatccagctgagtctcctcttccatcctgaactcaatttccgatggagcaatgcgggatactgcggcgattggatagtataccgttagtgccataacacccgataccgttaaaacagccgcagaaagcaatgtcagcatgattaaggtcttcgcgttagagcggatgcggtatataaaatttggtatcgtaatgattctggtttctgtgtaaaacgcccgtttgttccctttacgtcttttcattacataaggcagaaaggatgaaataaaaaatatagtacccattacaacaagcattgcagtcagcataccaactggataaaagccgatagaattccagacggactttgggcctctggtaatatccagcgccagcctatagcctgctattatcattacaattccaagcaaagcaggcagacggcggcatttcaaattcttttccgctttcttttcaaagcgtatcatttccataagagatgccttataaagaaatctggcatttgatgctgttaaaacacaaacaaccagcgcaataaagcaggccgttttcatcatggcatttgcattaaaaaacgggatctgtgaaccgtccaccgcgagtttcagaagcacagtaattccgcttacaatccccttatgtgcggctgctcctaagatgattcctgccaaataagcaccgcagcttataaaaatattttcaaaagtcagcaggcataatatggaagactttcgataccccagtaatgcgtagacaccaagttcttttatacggcgttttagaaaaaagtgattcgaataagccatataaaccaccacaaatgccattaaaaatatagaaatcgtattgcacatggactctacccgcccgtccgctgatattttatcaagcatgacctggtccactgaaaacgaagtaaatgcgaagaatactgtaatcaccagggaaacagaaaataaatagagggcataatatgaaacattttttgtcaggtttttatatgctgccgtcaaggtattcattgcctttcctcctgccttctagtatcgagcttagctgcttccgaggagatagcgtcatagaactcctgtctgccgccgcgtttgaacagttcccggatgatgcagccgtctttaaatatcaatatacggctggcgaagctcgcagtgtaagtgtcatgggttaccatgagtattgtagtatgcagttcccggttggcttcctgcaacgtattcagcaattccgtagccgaattggaatccagcgcccccgtaggctcatcggcaaataagatctccggctgtttcacaatcgcccttgctgccgacgcccgctgcctctggccgccggacagttcacccggatatttattcagttgtgatgctattccaaatctcccagccaggttccacaccatactttcgatttgttccggcggcagtttcattaaagtaaggggaacagatatattttcccggatggtaagactgtccagtagaaaatattcctgaaagataaatcccagattgtcccttcgaaaatcagcagcgcttgtgtttgccagtttctttaagttaacgcctttgatccagatattcccgcttgtgggcgtatctatggtagaaaggacattcagcagggtggtcttccccgaaccagaggcgcccataatgccgacaaactcccctctttctacgcgaaaggatactttattcaggcttgggtactgcgccttttcataggtcttcgttacatcttcagccactaataatgcagtcattgtgaaatctccttttacttttaataagtgtataatacaagcgcggtaaaaaaaacgaatgagtaaatcaggcactttttgtgtggtccgcccattttcaaaaaaattaacttgcgtgtgtttaaaaaatcctaaaaaacggatgcggcgccctcccttaagaaagcgccgcatccgggcttttttccgctatttttttgccttgagctatccgtcttttctgaatttcagtgcatacatagggccaaactgtgagtaaaagaaatccagtgtgacctcatatttctccccatccatcagaatgactgccggtttctccctttgcagaaattccagcttaattttattcttcctgcaataatcttctatttcccggcaaaaagcctccgctccttttgggcattcatccagatcaacgaccaggtatctgcctttgacagttctgccattcagctctttcgcaattttcaaaacagaacggtaatccagtatccagcagaccagaaccactgccgcattcaccagaatgatgtgccgccaggactccgacactataaaggacagcaatacaaaaccgacagcgatcaaatcgatccagtacacagctgccgcccctttaaaccagctgctgacccttcccttctccggcaggtaatgtagccaaaccagcagattgccgatcaccagatatcctgccagggctgcgggaataaatggcagtatccggcccacctcgttcatatcttttctaagactcaaaaacagcgcagtactcgcaaaaagaagcagccccaaaaagcatccctgataaatcttctctcttgtctcttcagaaatcctgttttctttcataacaatccctccttaatcttggctctgagtccttttaaatatttccttgaaatataggtaacgtcgccatttgcaaattctgcaatcataatcccaccgactgacggcttatagacctccactttcgccatattcagaagcaccgatttggatgccctgacaaattccggcggaagcagtccctccagctcataaagacgcttcctcgtagaataaatatcctccctggtatggatatactgtacctcctgcatagattcgatgtagtaaatttctctgcacttaatctgataaatcttatcgtccttgttgcaggttaatatcagaaacttatatctttcctgttcaataaactgagccagccttttcgtactctcgctttcctcatgcacgcggatcctggcagattcttccgtctctatccctactttttcgatctccaccttcatatccgtttcctcctgcctttaattgaattgtttccttttctgtatttatcttatccaaaataaaaaagaaagtctacagaaaaccggtcagtggctcttttgggcaggtaaaaggctgccaaccggggacttgaatccccgaatggcagccgcatcttattttatcatcttctcattataaaattattttacttgcctgactccttattaccgcatccgaaagatcgggctgatctttttataaatcaataatacaatcagggataccagcacaccctttaatagattgaacggcgccacagcaaacataacgaatgtggtaagaccagtaatacttgcattaatagccgatcccatatccaccagcgcatcgatcggcatcccaaacgctgccgcatatgccggaagaaggataaatgcattcagtacgcatccgatcgccgtcataaaaatagtccctgcggttagtccgataattgcacttgatctggtgcgctttttcttgtaaatcagtcctgccggcacacataatgcacatccgattaaaaagtttgcagcttcaccgacaccggcagtgatcgtcccattaatcaccaggtttaacaaaatctttacaagctcaatcacggctcctgccagcggccccattacaaaacatcctaccagtaccggaacctcactgaaatcaatctgataaaatgcgggcgcaaatggaagcgggatttcgaacagcatcaataccgttgcaatggctgataacattccgatctgtgcgattgtacggattccaattttagattgtgacttttgtactacattactttctgtgttcatagtcgtttctctcctttaattatacaaatgatttgaattgaaaagaaagaaaatcttcatggagatcgtgtctcagacataataaaaaccccggatgataattccggggttaagattacgcttttacggcatcaatttcttctctcatccagactttactgtcggtactggaattacaccagttcaaccgctgtcattatggcagtgggtcgcggactataccgccggttgggaattgcacccgaccccgaagaattcgttctattctataggttattataacccattatatgtggttatgcaagcagtttttttggtcaatttcaccaaaattttcacataaatctttgtatctcgttataagtaatcttcgaaatgtcgtaaatttgtcgtaaacgttgctgtgaactctgccgtaaaagctatcaaaaattcggacttatatctgcagaattcaaattacagccctctgtttttcatcttccattggcttcttatttagttttttcatttgctggcggatacgttccgggttcactgagtcgtaaacctttaagatcattttaacatttttgtggcccatgatatatttcattgtgcttggatcaacttcagcttcggccatcactgtacatcctgtatgcctgaaaatatgatttgaaattgtaggaaaatctttgccggtcttttccttgtacctatctactattctatataatgctttattgatgttagttggatacatcggtcctcctctttggttaacaaatacaaagtttgaatatccatcaacttcacgctttgaaggatttttcaatgatttttcccgcagcttttgaaaagcccggtatacctcatctgtcattggtatgattctcttcttgtttttatcagttcccttcgtgatgtaaaactgagtctttccattcttcttacgatatagtagcccatgatcaatgactacctcccgccttttcatattcacatcggaccatgttaatcccacaagttcactgacccggcatgaaagtccctgcatcactgtaaatatcagataatatttttcagcatctcggaacatttttatgatctcattataaaagatatcccgttcttccggggtcattgcttcccgcggctctgaacttgaataatccctgcagcagccatctgcaggatttcttcccagaatgttgtcatctaccagcatttccaatgcaggatgaataattttatggacaatctgaattgtcccatcctcatagccttccctgcttaacttgttgtaaaaggcttttatatctgattttacaagatcaattgccttcgtccttcccaatggggaatcagcaatatcctttttaaaataatatctataattttcgtatgttgatggtgcaaactttcgaatctccaaatattttcgaactgcattcgccaacgttatctgagctccgctgatactggtatgctccctcaaatgcttttcgatctcttcttccttttcccgaagagaaatatcaggtgttttataaggcggcatccggtctgtcggaactaatttccaactatagacagaacgtctttctcctgatgaatcggtatacttatactcatattttccgtctttcctttgtgtctcacctccacgtaaaatccgcccttttttatctgttcttttcccagacattttcagcgcccctttccttacttaaggaagagtcttgctatgactcttaaaacatagcataacaagaccctgatttcaattctgtccacatttaaatggaatagcagccggcaagatattcatccagtaacttccgcttaataagacgctttgtaccaacccacaatacaaacttgcagtcctcagaggcagtcatatttttcaaagtgtttactccaattccaaaatatgctgccgcctcttctaatgtaagatttgatttttcccaaattgggatctcctttttattcattgttgtttcctcaaacttctgatatttcgtttttgctatctggaagaataaagcttgtctaaagcaatgcttatagcgaggcatttgtctacatctaacatatcactctcgtttaagtgaccagcaaattcatgcagccgactcttatcgactgtacggatctgctccagaagaaccagtgaatcatcttctaatctgccatttgctttgatgagatgatgtgtgggcatcttggctttcgtctcaatcctgccggaaagtgctgctactataacagtcgggctgtaaaagtttcctatattattctgtatgataagagcagggcgtaaaccaccctgctccgatcctaccactggctctaaatctacatagtataaatcacctctgtatattctccctgccatgttgatcctcctaatctgaattcatagcatgcctcttttgtccccgacaccctggcatataggaaatcatcaaacggctggctgctgacctgctccacgagatgccttgcctccccagccaggttctctggctgccgccctcattgcctgggacgctctgaacgcacgggctgtgactggacgggagtatcattatgcctattgcctgtcatcgccttgccgggcgcaatccggcaattatcacgaaatgtttcccgcttatgcagccaagaagcacaggctgtcatataggttgatgctgtctctgtgtcctgcatgtcatggcgcattcgtgaaagtagctgctgctcatcacagcggcaataggaatgtatctgatgaatgggtattcggttatcaaagtacagcccattcagcagaacaatctggaatggggagaaaaaagccttctcatcctattcctcacttaaagctcaaaagtaaagtctagctttcaaacttttttattttttctatgattttctttcttgctgcatctatggagtatttcacggccatttttgagcatccctccttttgtgcaatttgatcgtatgtataatccatttcatagtaaagaagaaaacgattccgctgtgtgtctggtaagttggcaatttcttcaaataacaatttatttctaagcttgtctattaccttgctttccagatctatttcatcatgaattgctcgtctctgaagctgtacttcagtcaaatccaaatgctctatatgtctgtcaaaaatgttctcctgacttttctggcgtaattctgaattcttatacacttggtatactgcttcagaaatttctattttggctgatcgccttccgtcttcaagataaataatgtaataatgtatttctttttctgatttttctataattagttcatatgacttatctttactgccatacatattcattcctccaatccaaatttttcttaaatttgaattggagggtggtgagcgtatccgaaacacatcacgtatatatgtaaaagtaaaaatagggcatatttctcctataggaaatatgcccttacatattattaactttggtaaaaattgtcgatatttgtcgaataaaaaagtgctatattccacactctgaatgtagcaccttttgtttgcatttcttaaagcaaaactatttttgtaataccatctcttttgtttttttaaaaatagagtttcactcaattttactatttatacttttgttatcataaactttatttcgtaggtgtagcataaatgataaatagtaaattcatgaaacttccaatatcatccttttgtcataattacataccatatcatagaactttttctttcaccaacgataatatatgagcttattgaaactaaaactattctcatgcacaaagctgtactctgttttccgtgaatactgatcacagattaatagatagatttccagcatactaaaagcagtcctgtaaaatcagataataatcttacctaaatgtaaatcataaacacaaaatccaccagactcaaaattctggtggattttgtggattctatgttgctgataccttattttgatatggcattccctctatttttcactttttaattttaaggtatacagtaggtacaactgcatagcctaaattatatacctatatacccaaactcagacactacaaagtaacatatttctattccaatatatcaatagtactcatttatcagcccacgtaccatttttgaccattcttttactttttctaccggatgcctccccagagtccctcctatattcagaacaatctccgtgttgcacccgtgttttttagatgctgtcaggacactcctgatctctttttcagcattttctttatcccacctgtcatttacaaaatgaactcccgccgcgcggtaactgtatacataatcccctttgattgcatcagcagcatgttctacatcacaccattcactaacggaaatctttctcgcattattcagaccacgtatcaggtcaattttatggtccaatacctcacaacatcctacattaatatatttgaacaggctcataacttctttatcatatgcataactaaattcatcgtgcatagcatttgatacacagttaaacacctccgcacacgtgaatccccatgagtcacttaatttgactttatgcgtgaaagggtcttccacatcccggaaatccggaatacccgtagcataccgaagtcctgccgatcccagtggctcagaattatccagtgtcccccagattcctgcgtcttccagcatccgaaaacgtgccttaaaattatccgttattttcctaagagcggcgtgcatccattccggttcatcatacatgtccatgtaggtattctccatccccctgaaccaggaaaactcatcagctattttcgccgccattgtatgtggcttttttaacactgtcagtattggatgaaaaatatcatatgcctgttcatagttaagacgtgttgtctctttatcgtaagtcagttttggcatacgcagtttctctatgtctgaatcttccacaatgacaggaaccattgcataggcgccactttcatcggtatcattatctgtacgttcaattttacgctcaagcccttcataatcttcaagtccaaaaacctgctgtgaataaatgaccggctccagcacgttatcatcctctaactcttttgaataaaacatttttgtttttaagtatgactcaaattgccttgctgtttgatcctgacatttataagaattctgcggcaagatctcatttaatgccagcggccagtaatggttaatgaaaacgggttttgctgcacctgacagatcattgattgcataccagttttttcttttcttttcatttatgtctgcgtgagctaattctgaatatcgttttgctaactctcggagatattctctttctttgcttgttatcatatttttagactcctttaatcaaaaaccccaattccggtttaaaatactttaaaatgttataattgtcttcacaatttcggcaccttccgagatcgtttcctcaaaagctttttgtatctcctccaatggatatactctggaaatcatcgtatctgcattaatctgcccttcctctagccactgcattacttttgggaattgatggcagttcattcttgaaccaactaaagtaagttctttctttgtgattttcacaggaggaataccggctggattagaatcaaacccaattacagcaatgcgcccacaaggagcagccatatctactgtctgttctgttaacggagctgcaccaacggcatcaatcactacagaagcccctcctggagaaaaacgctccaccgcctctctcagagattccttattactgttcacggtaacgtccgctcctgcctcccttgctttggaaagttttgcgtcaaccacgtccgcaaccagtaccttcgctcctaagccttttgccgcctgtgcaacacagattccgattgttccgcttccgataataaccacagtgtcttctgatgatgccattgttctggacagtatattcgccgcaattgagaacggttctgccagtgcggcctgttcgtatgatattttgctgtcgaacggatataagtgtttttcttccaccacaacataatcctgaaagccgccatccatctgaaccccatagcattttacatcattgcatacattctcgtggcctgtacggcaggtcatacattccccgcaggaaaataccggatccaggactacactgtccccaactttcactctggtcacactttttcctgtctgtttcactaaaccagacaactcatgccccataactctagggtattccacatctgcgcgttcgcccttaaaaatatgtatatcagttccacagatacctactgccttaatttctactaagacttcgttttctgattttattgcgggcatttcctcttcaattaatttaattgtattcgcagaaatcagttttgcagctctcatgtttaatctcctctcatcttttgcggatgcttgatatctttttgtgcatccgcttattatttggcattattattcatattttatttaataaaccatcgtctatctcaccatttcagcatcagcaccggtattttggtgggctttgataactgtttcaatttcttcgcaagaagatgcctgcatatctcccgggattgtatttttcactgctcctgcagcattaccaaactcaagtgctttccggcagctgccatcattgctcagcagcccatacaataccccggaaatataggcatccccacttcctattctgtctataacttcaatatttacataaggcggttcttccagatatgcatcatttaatttgtcataaattattgacccaaacgtatgcagacgtggagaatgtactacccgctgcgttgaagccacaacatgaattgaatattcgtctgccagttcacgcataattgtcttaatatctcccgttttcttaaaagtgagccttgcggtatcttctgaacagaaaaaaatatcgacataagaaagtatttcctcaatagctgtgcgtgcttctgggccactccacaaattactcctgtaattcacatcaaatgaaatcagcgctcccgcttctttgaattttttcatcatattgactgctgtttttctcgtgttttcacataaagccaaagtaataccagtagtatggaaacatctggctgaggaatatatctcatctccaaattcttctgtgctaattttcaacatagatgtatgcatcctgtcgtatactattctgggtttccttggatacgcaccgttttcgtagtaatatatgcctaacctgccgtttttcattttatcataaacaaggtactcatcactgacccctacaaatctgatcttgtttctagcataaatgcctatatcattatcaggtatttttgatataattcctgtacgcagcccgagaagagatgccccgcttaaaacattcagctccgctccgcctacttgtttctcaaagttatcctcccgcactatccgctcattctgtggcggtgacaggcgcaaaagtatttcccccagcgacaggacatcgaattttgtgattcccatttttacctccttatatgctgacagggaatgcttgcacatcccccgcctcctcatggaatcaagctattgctgaatcaaatgcacagcaaacccaccgatttcttctttcagatataacaatattagtttaccatcctgatattttgccgtctccatattaaacaggattccctgtctcgacaaatattctactgctcttggtacgctgtttacagatactgcaatatgtccgttctttccaagataaggtgacttcatcatttcaattccctctcctgcaaatacggaaccatttccgcttttattcatgaatccgaaaagagtttgaaatctatcggctgcatgttctgcttcctctgcatctttgcagttcataccaatgtgcttcagattaaatcccagcatagtcattaccgcttcccgtgtaagctctttaattttttcaaaagatccattctgtatcaaatcactttttaccatccagcttccaccacaggcaacaattttatcaaatgcaagatattcatttagattcttaatattgattccgcctgttggcataaacatcatgtttgtatatgctgctgacatagactttatcatattcagcccgcctgatgcctctgccggaaaaaacttgacagtatcaagtcccagctctaatgcctgctctatctgacccggattggtcacccccggcacaataggaattcctttatcctgacaatgctgtacgacctttggattcaggcccgggctgactataaattttgccccagcctccacagccttgtcagcctgctctgtcgtcagtaccgtgccagcaccaactatcatatccggatactcctgcaccatgatacgaatggattcctcagctgcttctgtgcggaaggttatctcggcacagggaagcccaccttcacgcaaagctttcgccagcggcgctgcatcctttgcatcattcaaaaccaccaccggaacgattcccaggctctgtattctcttcaaaaccacgtccatgcttctctcctctttttatttaggctgctttccaatatacgccagaattccgccgtccacatacagcacatgcccatttacaaaattcgatgcatcagatgcaaggaagactgccggacctgcaaggtctgaagggtctccccaacgcgctgccggtgtttttgaaataataaactggtcaaaaggatggcggcttccgtcttcctgcggttctcttaacggagcggtctgaggcgtggcaatataaccgggccctattccattacactgtatattgtactcgccatattcggaacagatattcctcgtcagcatcttcagaccgccttttgctgccgcataagctgatactgtctcacgcccaagctcactcatcatggagcagatgttaatgatcttcccatgcccttttttaatcatagaaggaatgactgcctttgatacaataaatggagcatttaaatccacatcaattacctgccggaattcttctaccgtcatctcacacataggtattcttttaatgatacctgcattattcactaaaatatcaataatcccaacttctttttctaccttctctacaagcgcattcacttgcttttcatccgttacatcacatacgtatccacgtgctttgatcccgcactcttcgtatgctgccaatcctttatcaaccagctcctgtttaatgtcattaaatacaattgtcgcacctgcttctgcatacccttttgcaattgcaaaaccaataccataagacgcacctgtaatcagtgctatttttccttccaacgaaaacattctattctccattttttacctccatctaaaagtttaatccttatttttaacaacacaacactgttctgctcctactgattcagactcttccatccccaactttgattttctacttctgttgataaggacgcagcatatcccagtcaaattctacccctgtccctggttccttactggtatcaagatacccttcctttacgataagcggctccactgtgtactgataaatggggaaactgtggaattccacatatcctctgttgtccagggcccccaggacatttgcgtgaagctcctgcattccatgtgaatgcacctttaaggaatattcttctgccagagcgcctactttcataaatcccgtaattccgcatacattagaacaatcagggatagggcaactgattctgcctattttaattgccagctcgtgttcataaatggaatgcagattttcacccatggcaatcggtattgatgtagcctgtccaattcttgcatacccttcataatcatccggatttgttggttcttccaaccatccgacattatattcttccaattggcgtgccatccggattgcctgctcaacagaccataccatattggcatccaccataaaaagtgcttcattaccaagcaactttcttactgcttttactctctggatatcttcctcttccttttcccttcccagttttatcttgattgcagtatgccccgccttcagctgcgtctcaatgttttcaagcagttccttttctgaatacattaagtcaataccaccgtaataagttcgtactttattcgtccctgttccattaacgtctcttaatgccatcttcttcgtcttgagttcgatatcccaaaacgcaatatccaaagccgaaatcgcaaaagaagcaacaccacctcttgccacataatgaatatgttgattcatatagtcgttcatctcatacggtgttttcatttcaagtccaatcagctgcggtatcaggtcattctccagcattttcgcaattgccgctcccccgaagccaccggtgtatgtataaccaaccccgcttctgccatcttcaagcataacagttgctgtcacaagttcaaaaaaatcgtgttttccatgaagagcatcaaccagatttccttccaaaggtactctgaaatactctatttttatttgctttatgatatttgacatgttctctactcctaataattatagttcatataaactgtttttttctgaaggtaaccttccagtccatgcttaccatcttcaccaccaatgccacttaatttatatccattatggaacgcatttaccatctcaccattttctctgtttgtatacacttctccgaattccagctcgttcactgcacgcataatattttttgcattgtttgtaaataaataagcagacagcccataatcgcagtcatttgcaaacaatagtgcttcatcaaaatccttaaccttcataattggaagaaccggcccaaaggtttccttctgcatcagctcattcttattatcatctacctctacaatcattggatacagccaattaccgttctgtgtcggcttcacatcaggagtcatatccaaaagtatcttcccgccctcttccagagatttttgaaccatctgatgaatcttatcaacctctgcacggtttacctttggaccaatatctgttcctggtgccttagggtctccaacaatcagcttctttgtctcttcggccagtttttgtttgaattcttcatatacattttcatgaatatacatgcgttcattgcaggtacatatctgcccgcagtttgaaaatcgggagataacagcgcacttcacagccttatctaaatcagcatcgtccataacaataaagggggccttacctcccaattccagacgtacagccacacaattatccgctgccgctctgaacacctcaagtccggcattggtactgcccgtcaatgttacaagctttacgatctgattccgtaccagggcatctccaaccactcttcctgaaccagtaataaaattcaggacacctgccggaagactgcttttccctgcaatcagttctccaaacctcatgactgtgagcggggtttctgatgggggcttgacaatcattgtattgccacataccagcgcatttcctatttttcttgctgccaaggccagcgggaaattccacgctacaattcctactgtaactccgaaaggaaccctctgaatccaagcctgctcattctccatctcagacgttacaatctcaccttcaattcggcgagcagattcagcagcatatcttaagaatcccgcagccccttctacctcaccgattgcttcatgcagcggcttaccatgctcagtagtaagaagatctgataactcttccttgttatccatcagaagttctgctaactcaatcaaataatccccgcgctgtttggctgttagtttccgccaatctctttgggcccgctgagacgacagaagtgctgcctgtgcatcttcttttgttccttttggaacactgccgatcacttcattatttaccgggttcaatacatcaatcacttctccggataccgatggaactaatttcccgtcaatcaaattttttaaattatacattagcactctcctttttttatttattgtatactattttaaagaaaaaatcaatttttttgtataattaattatttatttttttatatgctgctgtttacaaacagatctgtgaactaatgccatttagttagcgattgaataattctattcaggaataggaaatattttcttttcattaataacaaaccttcaagctctgcgcttacatttgctgagtccgtaatcttgtttgattttgtctctaaacggtagttattaatacgtatctcctctgttgccacaagcttaacaggtttccatattttaaatggtatcaatcctgtttaggaatcccctccgtcatgtcctgctcgggcttcaaacgctccatccgtcaattgtaaccactgaaatcctgtgtccttctgccattgttacggaaatttataaacctttattttcctatactcttaattttacaaattgttcatgcgtgagtgtctttccctctcatattctcttggggtcatcccaacgcgttttttgaatgaacgtccaaaatgttccacacttttataacctactgcatcactgatatccgccaacctcatgtttgtattcttaagtagctttttggcggcttccatccttatgtcagttaaatattctacaaatgtgatccctgtctccttcttgaatttcacactgaaatacttttcattcaatcctactatactggctgcatctgcaagattcagactggggtctctataattatcctttagataacaaatcaccgtttcaacgctgccatctgtccctatatatttctctctgtgtgaacctccatatttgttctggagataatccatcagccagcggttatagttggctatccacatcatcattgtactgctctcatccagccgcgacagcttttcattaaaatctatccccccccacagcctttgtatagaatcacctatttcttctaaaaataaggactcaaagtataatagttccatgcaggttttcttagtcccatccagacttgtacatatctggctgttaaaaatgtccgactggcattccagcattttttctccatccagcattttaaacgcctgcagaatccccctgtacttctcctgatttgccaaagcttcgctccaccggaaaccttccacagagtcctctgtgaaaatactgttttttccaaatatatgccgcaccgacattctttgctctgcctgatatatgcaatcgttaagtctatcctctcccctggaccaatcacttactccaatataaacatccacattcatataagtctttattacctgcatcaaccgtaatccaaacgaatatatctgctccgtccggattcggccggatctatagcagatcagcagactggcgccggaatattcgataataaaactgtggtttgcaattctaggaatctgcatgatgattttccttatcgtggcagccatctctctttccgcatgggaaaaactgctttgtgccgtgcctgcatcagccacttttaccacaaggcagtaatagtcctccagaaggggggggactgatttcctattgttcataaccatatcacggaacagctcttctttcgtcacattttctattatattgctttcctgtagttttttctttactttcaacactaatttttttaatgactctggattcaattctgttttcagcaaataatcttctataccatatttgaagccttccctgacgagatcaaaatcactataagagctgacagcaatgatttgtattgtattgtttatttttctgatttcactgattagcctaatcccccccataatgggcatcttcatatctgttatgatcaaatggacggtggctgtttctaagaactccaatgctgccttcccattctccaccgcaccgacaacatcaaacccaagttcctcccagtccagcaaacttcgaatgcctatgcggttcgtcatatcatcgtcaacaagcagtacatgatacattacatcaccctccatttataaccggcagttcaaaatatatctctgtataaaatcccgcctcacttttaatattgatgctgcaattttctccataatatagcttcagacgcttattaatattggcgattcctattttttctccgttatccggatattttcgtagtatagaatagatttcgctttcctcaatcccttttccattatcccatatactaatataaagcctacctttccttttcttcaccgtaattttgattcttccaatatccgttttctgctcaaatccatgagttatggcattttcaataaacggctgcataattaacttaggaaccctgcatgacaggcacgtgtcatctatatcatattctacatcaaaattattcacatatcggatcagcataatgttgatataggactggatagaaagaagttctttctctactgtatggaagcttcccttatcccggaaagatacgtttaaaatgttgatgagggattccgtcattatttgtattccttctaaccgggctatcattgccataaatctaatgctgctcaatgaattggaaaggaaatgaggatttatctgcaattccagtactttcatttcctcttcatgcttttccttctctttttctatattgtcccgtattaaactctgtatcatttccatcatctgattgtatttttctttaatcattcttatttcatacaggccatagacttcccgcttctttaactgtgggttttctgcttcccgcttcattatgtccgacagttcggtaatcggatttatgatattcttaagcagtctgtttataaataaatacagtacggtaaacagaatacatgtgcttccggcaattaaaagcaggataatctgatattttccatctaccacatcagcgtcagaaacagcaattactttccactttgtcctctttattgattgaactgcataatgcagtttatttccatgatattcagacatgcttatttcacgggctgtattttcatatgccaagctagaaccagcaagcaccctgccatgagcatctgtcagatataattctatgttatctgtccattcaccggaggtttttattaactccagcccatcagagagcacacctattgtacctgcttttactgtcgtgccaacgcccaggtccttgaatcctaatgtaaaaaacagcagattttctcttgctataatctggggtctgttaaattccctcttatcaatgacagaaacatgtacaatatccggttctgattctgctgttttataccattggtatgtgttccattccttagcaggctgtatgcttatattttcaaaagcaaagctgctgccgtcctccattaaaaaatcaacggacacgatttgaggctgcatgaccagcctcatatggaactgatctgataattcgcggtaatgcttatacttgtcattattggacgccttattgtagaaagtcagttcccgcagaataaccctttcgtttgtcctggaaaaatgtgcaagctctcttgcataatccgacatttccctttccaaaatatctgccgcactttttcccgcaatagataatttgtcctgctgctcatgatctatctgcctcaggaccagatacatacctgcaaaaaatataaggatcaacggcaggaataccagctttacaaacatttttctataataacgctgtatggttaagtttttatcagctttcatactcatcaggctccctttttggaagacttattgccattccaaagttttcactttagttttcagaaatattaccaccatccgagagttttcacattactacccggatactggtgggcaaaggcataaggatgcctgttatccaaatcaaacctcatcagataattataatccgaagaacgttcatcacaatggcataatccccagcggattccctccagagggtattcatcgttgtgcttgcccctgaatgccccgcctgccattggtgtatcatatacatgggacataatttcgaagtttacgccatcttttgcatattgtatggtatccttttccggaccatcccgattcagaagcgcggctattccccctttatactcccataacatcgtctcatgcccgctgtttgtcaccggattatattcgctgtggacatacggaccggtaacctggccggaaaccgccaccccccaccgtgtatcctgccccgaactttttaatgaacccaaaggggatgccccacatttatagtatagataatacatcccgttgtaataaaacaggcttgggtcatgagtcagtcctatatacgcgccgtcattataattgtcatggctgccaaaccactccccgccctgcatcttggtcaggatacattctttgtgttttttccatgggccattgggattatctgccactgaaagtccgacactttcaccatcttcctcataccggctctgcgggaacgtctgatataccatatagtatttccccttgtgctccatcacatccggcgtgcagacagtacgttcatcatagtcgccctgttctcccctgggaactgcacagccccgttcttcccagtttatcccatcttcgctgactgcataccagatatctgcataatcccacggaaaaatcttagtgaaccggtttctctgggccgatactccaaaatgtggtcccagcgacttggtgtaccacacatagtaaataccgtctgcctccagaacactacttgggtctctccgatgcacgcctttctcatatcctattccttttacttccgtatatgtaaaacctccaaaccatgcttccccgtggttcttatattgctccgctctcagcgttgcagcactttttttcatagacatcgccttcctttccatacattcttagtcacttatagcaggacatatccgccctcataataccctgtactttgatcagccttttatggctcctgcagtcattccctttataacctccttactaaacacaagataagccagtataatcggcagtgatgtgcacattagcgcagcaattaaaaatgtataatccagttttttccctgaagtaaaataccttagtgcaatcgatactgtcctcatatcctcccgcggagttaagatgaccgcaaaagcaaattcattccatgtatttaacaatgtcagtatgctcgttgttgctataattggtttacatagcggaaatataactttaatcagcctttgcgacatgctgcatccgtcaataacagaggcttcatctatgtctttagggattccggctatgaaactttccgccagaaatattgacagcgtaatcgacattccgtaatacgtaacgataagcgccagccggttattaatcatatccagcatcttgtactgcacaaacatcggaaccagcaaggcatataaaggaatcagcatacccagtgtataaagaaaacgaaccgccttttttcccctgaaatcatatctggcgagaaaatatgccgttgtaatagataatattactacaatgataacatttatgccggaatagaacaggctgtttaaaactgccgtccctaattttccaatctcaaacgcttctgcataattgctcagcataactgttcttggcaatgccaaagtattttgcataaactccggattgggcttgactgacgaataggccatccatatcaaagggaaaatgacagtcgcagaaattccacatgccacagcattcagcagtataccggctatcctgttagttcttttcattttttcggcctcccaatataaatgtggatactgcaatcaggccaagcgacagcacagtcatgccgatagccgttgcagatgcgtatcctattctttgtgtttcgaacgctacatcataggagtataatgcagttaccatagatgcccttccgggcccaccgccggacataatgaaaataatatcaaacaatttcatacaacctgaaatacagatcagcaaacagaccgcaatggtcggcctaagcaatggaaatgtgatatgcaaagcgcactggagcctggatgcaccgtcgatttgcgcggcttccgtaacatcaacgcttatattctgcatgcctgacataataataatgacaaactgcccgacatactgccatgttaacgtaaggcatatactgggaatcacccatgatgtactgttcagccagggcagattcccctccatccccagaagctgcagcactgatgatatgatccctatatcattgcggtataccagctgccacagcattcccaccaccataggcgccaaaaccgccggcagaaaaataagccgtctgtggaattctcttgccctgatttttttgctttggtaaaacaaagctaatataaaccctaagccaatttgtgctattatcagaatcgctattatttctaaattgtttaaaaaagctccccaaaatgccttatcctgtaataacctgatataattatcgttcccgacaaaatccattttttttccgcccctccagtttgtaaagctaattcccaagcagataaaaagcggaaccaccatcgccgtcagataaaggataagacccggcgctatatacttataaactctcagagattttccttcctgaaatttattcataattaaaatcccccttgtttcttactccagccaataaattcgtttgcgatgagccggatgcctgctgccgcagctttccgtacggtctgcgcagtgaatacgcagaccgtacgaactgtcaatggaattttactgcagcagttcatactcatcctgcatattctgcgccagctcttttggatcaatcgactgcatcaataattcctgcagccctctctgatatatttcttttattgtggggtcgagtgtggaatcccaattcatacatgcagtaccgtcttttaccctattgttcatttctactgccggagccaccagtttagattcgtcatagtccacttcccatgcagtaaattcattattttcttccacaattattttcccggtttcttctgtataaaaataatcttttaaaaatatttttgccgcctccatttgttcatccgtaattcttgatcccatagcaattccccatgccgctgactgtacaatggaagcttccgctttaccgccggaagccgggccgggccaatgagctgcttttgtgactgagctaatttccggcgacattccatctatattcttacattcccagtcaccagcagatatcatagcggctttcccatttgtatataatgccaaacgttcgtcattactaatacttgcaaaatcgtcattaaagccattattctttgcaatattctgataggcggcaagtgcatctacaaattctttgtcagtaaaactagcttttccattacattttctaatattctgataccattcattcccgacgaaattattcacaaatgcactgaacaggatagaatctgccgcccagggatccctgtctcccaaggccatcggtatatatcccaattcccttaatttagcacaggcagtattaaacgcgtccagtgtcgcaggaaattcactgatgcctgcctctttgaagatattttcattgtataggataaatccataggtacctaacgcaatagggaatgagtaaatggcatcatcgtcaatattcgttccttcctgaatcagacccggccgcagtacctgttcaagtccaatgtctttatatacatccgtcagttcaatgattgccccaatatcagaaaaagccttcatcatggttccctttaccattacaagctcagacaggtcatccgccgtaccgcgggcattaatctgggtcatatatgcatcctgaggcatctcctccactataatttctgccgaattggcatgatccttattgaaccgctctatcgcaggagtgattgcatcattccacgattccccttctacgaaaaggtgagtaaacgtaagcgatactttctcattctttccgtctttacgttttacctccttttgcccctgaccgcatcctgtcaggcacgctgtcagcatcattgaacatagcagcaaactgatgattcttcttttcataactgtttacctccttcttgcatttcaggttcattagtatctatgttcaatatagcaacatcggtgacaataaaatatgatattattccatattaactgactgatttctatatagaaaaagttcaaatatctacaaataataataaagatcaattaacacctgattagagcataaaaatttcgatgcttacagataacaatctgaattcagcatcgaaattattttacgctataccatcctgccattccactgaatcagcaggaactaaactattttcatcaaatccacacaatcataccccatcttacatgatatctcaatccccgctttcgttactgctccgataatcccgtccagcttctcatccagttccttacgcttaatcacagaaatactgattgctccaacacattccctaagtctgtttctgacaggaacagcaatgcagaatagattttcattatcctcttcattatctatagaatatcctctggcacgtatcctttgtaattcattcagcagttcttcaatgctgacaattgtattgggggtttttcgaacaaacggcaccccgtccagcaagcgtatcacctcatcatcctgtctgactgccagcatcgcctttccaagccctgtcctgtaaagtgcattccgctcccctatggcacagctcgtacgaagcggcgatgccccctctattttatcaatatacaggatctggcttccgcttggtatagcaaaataggcagtttccccaaactgtacgcttagctgctttaaatatggccggactattgtatggacatcctgcttcgccatataagccatcccaatctccagcatccggactcccaacgaaaatccctttgtgtgctcgttaaactccaatgcgccttctaactccagagtatgtacgatatcaaatacgcttgttttgggtatacccaattctttgtatagttctgcaatggaacatgcttcacttttctttgatatataagataatatctccaaagtcctggttactgttctgttttttttctgttcactggcagccatcataatctccttttttcatcctctgataaaaattgtttttatttattgtaccaaatatgaaggcattcttccagaaatacagtgtgaactttactgcttgttttcttcttccaataattttgccattctggcctctacctgtgccatagcatcatctatcgaagtcccatttcccatcatagtattataggcttctcccataatatcccatacttccgtatacttcgggaatctgttctgaggcaccacatggttaacggcctgtataaaaccatgaaacgccggatctttaaatgcctcatcctctaatgcctcatcgtttacaggaagccttcctgtatccagggcaaactgcacggcctgctctttatccgtaaggaatttgagaaaatccgccatctcctccggatgttcacatgatttcgtaacggcatatccccccacatttaacgctgctgaatgcctctcttcttttggaaccgggacgctggcgagttttccttccaaatccgggtttgcacttaaaatcgccccaagggcattagaaccggtaatcatcaggcctgtctgttcctgcgcaaagtaagaggaagcttccggatatccggtttctgtcacacccggaggtactaccttatccttaattgccaaatccacaaagtcctgcaaggcctgtttaaatttatcccctgtcagatcagtcttccattttcctgactcatcctgaaatacttcttctacgccatatgccttaacaaactgtgaaaatcttgatacgcctgagctgttgtttgttccgaccatactaaatccccagtggccatctctggtaaattcccttgcgatctctttgaattcgtccattgtctctatgccgtctctgttcgtttcttccaaccaatccgcccggtaaaccagacctgtcggtatcacaaaccagggagacattctcataacgccgtcaatactggcttcttctatcactgtatccgcaagcccttccagataatcttctcccagaagttctgtatggtccgccagaattcccatttctgccgcaacaggtatgaactctgcggcaatgctaaaagcatccgggagatcatcgcttgtatttagggcaatcactttcttggacatctcgttcatcggaacaccgattaattcaatctcaacatccggattttctttcatatactgatctgccatggctttctcaagtccagcctctgtttccgtctggagagaggacataagcgtaagctttacctttccaggatcctccgctttcttatcatccgtcttcgctgcttcacctttcccacagcctgccaatacggccgcacacatccccacaacaattgccgcctttactttttttactgtaaacatcatttttcctcctgttcattttttaaccaaatatctccttcattctttttgatacatattctctgatcttttcccactgccctccttccagcaactctttacctacaaaactcgatcccaggccaaccccttgaaacccacgcgccatatagtcttctaaattttccagagacacccctcccacggcccagaattcggcctcctggaagggaccctgtaaagctttcacataattttccgaaacacccacggcaggaaagaacttcatcctgtgtatcccatattcaaggcataccgccgcctcggaagccgtataaatccccggcagcaccgggattttcctttcaacgcagaattccagcacctctctattcaccgaaggagttacaaaaaactgtgcgccggcatctctggccgtttcacacatttttttattcagaaccgttcctgcccctacaaagatttcgctgccaaactctgccctaagcagtctgatctgctgtagcgcatcctctgtattcatcgtcacttcaaatagttttatcccgccttcgcttactgccttcacaaaatctttgatatcttttgtcggcagattcctcataattacacataccctgttatctttaaatatgtctgtcatccttccattcctttccttattttttatcagcggtaaacccctgcttctccattcaagatccggtccatacgctcccacttggggaacccttctgtatcgcctcctgtttccgtagtaagggcgcctgcaaccacccccatatacccgcttaccgtgatatccttaccttccagaagtccgcacaggaaagccgcattaaaagcatcccccgcaccgactgtatcaacgcttctgcatggatacggcgcaacggccttcgttgtatgcctgtctgttactactgctccgctgcccccgtttttgacagcgatgctgcctgccctcccattgtccgtcaggtatcggacggctgcctctgtcccatgaacatcaaacaacatccctatttcttctaagccagccataacaacatccgcccggagcagcatttttcccaaattcttcttatatttccccccttcccacattttttttctaatattcgggtcgaatgcaacgggtatctgtctcttttgcgcttcctccataatatactcattcaattctctgcacgtatcgctcaggcagcttgtaatacccgataggtatatcatcctggcgtctaatatatagtccatgttaagatcagaaaccttcatgcagctcgcagcagagttcttcctgtagtacataaccgccgtttcattgccaggcctgatttctttaaacatcaatgcatttttctctttttgagattgtatcactccgcctacatcaacaccttcactgcgaaccatgtttagtatataatcgccgaaactgtcatccccaagcctgctgacccagccggcgctatgacgcagtttgcaggcgcctatcgctacattgctttcggagcccgcgattctttttttgaaataatctacataacataaatcccctttttcttcaggtgtaaaagatactaatgtttctcccactgtaataatgtctaacacttctgcctccttatcatatatcagtcatctgtttttcctatttgacggcgcccgccgtcaggccgctcacaaaatatttctgcataaaaacaaacaaaatcacaagcggaatgctggcaataaccgatgctgccatcatatcgttccacaatatcttgtaaaatccatttagttcagctatacccagaggcagcgttttcagttccggtgatatcagcagggtctgggcaaacatatactcattccatgctgtaataaaagcataaatagctgaggatgcgattcccggcagcgtcaatggaagaataaccttcaagaacactttccatctgctgcagccatctatgattgcagcctcatccaatgaggttggtatcgttttaaaaaagccaatcatcatccaagtgcaaaatggtattgtaaaggatatgtaaacaagcgtcattcccagcaatgaatcattcagtccataggtatccagcactttataatagggaatcaaaagcatgattgacggaaacatctgcgttaccagcaaaaaggtagtaaatccctttttgcccttgaatttaaaccttgtaacgccatagcccgccagacatgcaaacgcgactgacacgatgaccgaccctaaaactatgataatgctgttcttaaaatatgtcaaaaacgggtattcttcccagaggcgctgatacgcttcgatggtaaaggtctccggaatccatcggggcggaattatgattgtttccgattcaatcttaaaggacgttgacagcatccataaaatcggaagcagcaccaccacagcaaataaccccagagttatatacgtaccaatacctgccagtaatttcttgctcttagtcctcattctccaaaaacctcctatacatcttgcttatcaggacacatatcaaaaatacaactaccgacattgcagcagccttcccaaagtcaaagtagctaaatgcctgtttatatatctctaaactgataatcgacgtatcactcccggggcctcctcctgttaaaagagccacaatagtatagtgtttaaaccaccagattgtatccagaatgagtgttgccgataaaacaggtttgatggagggcagcacaatgctgaaaagtgtctgcagtttattcgctccatctatctttgccgcttcatatatatcctccggcacgctctgcagcgccgcaagtacattaatcataacgagtggaaatcccttccatattgccacggccacgaccataatgaatgcatatgtactgtcccccagccaggatatcccctgttcaataattccccatctttgaagataactgttcagcagcccataaattggattataaatccatttgaaaatcaacgccactacaacatccggaaaaagccaaggcagaattaatatcaccttaaaaattccaatccccttttttttctgattcaacagggttcccaacaggatccctattacgaaatgtaacgccacaaccagaattgtgaacttcagcgtcagcagaatctgttttaaaaataccttgtcagaaaacacctctgcataatttccaattccgacaaagttccatttatcccccagatctgtatcaaacaggctgattcccgcaccatagaataatggataaaccacgagcgcaacaagcagtaacaatgccgggaaaataaacagatacggggttaatttttgtaagggcacatccttagcacaatatccattctttattttattatgtttcatatccttcctcctaccattctgcaaatgagccgtcctcatgaaactcaacaggattcatccagcgcccgtcatattccattttcctgacctgctcctcatccacttcaactcccagaccggctccctgcggaacagggatataaccgtcttcaattttaaatggctgctttaataattgaacgccaagctctgtcttttcaggaagtgtcagatgctcctgtgcagtaaaattcggaatgcaggcatccagctgcaggcatgacgccagtgaaagaggtcccaatggattatggggcgcaatggagcaatagttgttctccgccatggcggcaatcttaaatgcctgcagaatccccccgcaatgacataaatccggctgcagcacctgcactccgccgcgcttaagaagctccctatatccccacgtggtaaatagccgttcacctgtagcaattggtatactggtcgattccgcgaccctcagcagctcatctgtattttccggcagaacaggctcttccacaaacatcgggtcatacttttctaatttttgacataacctttttgccattgcgggcgaaacccttccatgaaaatcaatggctatatgaatgtctttaccaacggcttttcttaattccccgaatttctccacatattcatctgttttttttggagtatcaatatgcaaaaacggataatctaaaacggtcttcagagctttgaatccttgtcttacccttaactgcgccttctcgcaaagttcctcagtggtcgggttgactgtcggggtaatatgtgcatacattagtatcttattcctgcatgcaccgcctaagagctgccatatcggcacgcccagggccttccccttaatatcccaaagagcctgttcgattccgctgactgcactgcaaagtatcgcgcccccgcggtaaaatccgcctttgtacattatctgccataaggcctcaatattcatggggttcttgccttttatacaggttcccagagtatggactgcattctcgaccacagtcgcccttccttcaagcattgcttcaccccacccggttacaccctcatctgtctccacttttacaaacatccaccgaggctttacatgaaatgttttaatatttataattttcatacatttactcctttgctttgtgtgattcgaagtaacttctcataatgcataacaaagacattgcagactaattatttatctgatatctttcaatcaattttctgtctatcgcaagtcccagcccttcatgttcatgtcgaataagataaccattgtctatatgcagactattcatcgataactcttccctgaaaatattgggagttctgtctaattccaaatatacagcagccggatttaagctttccggaaaatccggcattgcaaaagcagcatttatgcccacagatacagcaactgcgctcccccacacatggggataacattgaatattttcaagcttagccatcaccattattttcataaactcagacagaccacctgtggaactacagtccggctgaacaatatctgcacaccgctgctgaacgaaagaccgaaatccatatgctgtaaactcagcctcaccaccggcaatggggatagatacttcccgcttcacttcacaataccccgcatagtcctccggcggcacaggttcttcaaaccaggtaatgtcatattcttctactccttttgccagctttattgctgaaagtgcgttgtatgcatggtttgcatcaatcataagctttattttggagccgatttctgaacgaattcttttcaccaactgaatatccttttctactccaaatcccactttcattttaatcgcctgaaagcctgcatccacataagataccgcttcttccgccaattctttttccaaacggggacttatactgtggtagagcccagtggcatatgggattatcttttctcgccttgcaccgccgagcagcgtgtatacaggaaggtgcacatacttcccttttaaatcccagagtgcattgtcgattgcgctcaatgcctgtacgcaggaacctttttgaccgcagtcccgtaaaatattatataaatcatcccatatacttccgctttcaaatacattccgtccaattagccgtggtttgtacactttttcaacgatgacactattaatatatgcattgccaaaagcctccccaaatccactgagaccatcttctgtcaatatttcaaccaacatgattgtcctactgttataccacgcctgagaatagcaaaaacttttttcacctaagtcctgactgacaatatagactttaacttccctgattttcatagtattatgccctcccttcataaggcaattgatatccgctggatataaaaatactcttccaaactgaatacggaacaatccttgccgattccgctctgcttacagccgccatgcggaaggttaaattgatagcatggttcgtttacgttaacacttccggcgtcaatttttctagagagattcaatgcatctgaaagtgaattagtataaatatatgctgccagaccatattccgtatcattcgccatttcctgaagattatcttcgtctgtaaattctattatcggaataatgggaccaaaaatttcttctttatatactcgcatttcagatgtaacgcccgttaacaaagtgggttcaaaataatatcccggaagttcttttcttttgccgcctgctttaatctccgcgccttttccaactgcatctgctacaagagcttccatgttttccactgctccttgtgatgctaacggcggaactataatatttccgttctctttcccgctcccgaattttacggcattgaggtatccctgtatttcatctgtaaatttgcgtattatttctttatgtacaaaaattctgtttggtgccacgcacacctgaccgccattacttatctttccgtccgccactttccttgcagcgtcacatacatccgcatctttcattacaataactggtgcattcccgcctaactccaatgaataatgcttgatagatgtggcgctctgcctgattaccttttttcctgtctcactggaaccaattaaggtaatcatttgtgggatgctgctttcattcaatgtctttccaacagactggctgtctcccgccagaatgttaatgaccccggcaggcatccctgcttcaatggaaagctctcctaagtaaagcgtagtcaatggagtcaggctggatggttttaaaatacaggtacatccggccgccaaagccggacctaatttatatcctgcatttaacaaaggaaaattccatgccagataaccaactacaacacccaatggtttccttataatcatactaatatgtttatcttcataatccggaagaagctgtccctgcatactcttcatttctcttataaaataacatagacagtcagacagcatctggtaatcactttctgcattggtatatgtctttccggtctcttctatcagcctttgaataatttcttctctgtggctttccaggatatctgcatatcttaatatataccgttccctatcctgcattggcaatacagaccagcttttaaatgcccaactggccgcttccagcgcctcttttgcctgatctgctgtaacacctggaaattctgcaatcactgttccattcgcaggattataaacagtaatattttttccttctccgcgaactgcttttccattaatgtagtttcttatatgcattatttcgtcctcctatattcgttcgtatttgcgaacgccgttcttataattatatgttaccatacttgttacctatattcaatactattcttttatttttcatcttcttatgcacaaaatgacgatagttagaattgtatattcctgtcggcgcgaggtaagtaggtaagcatctgtatctacaaacttcccaccacatttgataggatgatttcaaactgaaatttcatctggatccgtacttccgctgtatgttcacgttctgcaatcgcaggcgcacagttttgaattttcggccggcagcatttccgaaagcacaagcgatatatgttattggcactggctgctgaaaaatgagcattttttacagggcttcgtatttcgggattttgcggactaactatcagggtcttggattttgaaaatcgtattatcaatgtacccagagtcagaagaataaaaaatgccgcaaccccattaaggactacggcgctactttcaccaatataaaatataaataattcgctctgcagtgatacgaatgcgtacggtaccaaaggaacagcatccacattaccgcttctcatcttttgtctttttctgtcttacagcctccctcatcataagccccgtatcataatccagctgtcttggctcatactcttcattttcccgctgtctggtgtacccatcattgtcccagcacggctttttatcactgcgccaataacgcacagcccactggtatccacggtaaggatctctcgtacggttcatatgctcaagcagacgatcatgaagaagttctctctcagcggcatatgcggggtcttcaatcaggttatgcacttcatagggatctgcttccagatcatagaattcatccgtatcaagtaaatggataacaagcttaaaacgttccgtcacagcagccctcatcatctgcagaccgccaaaaccgtcatggtccgtttcatagcgcgtaaactctatgtagaccgtatcatttatcctcacacggacatcttttatttgaggcaatatgctccggccttccatcaaaaccggaaccggaacccccatatactctaatatagtaggtgccagatcaatgtgagtagcgggttccgtaacaattttaccactttccccaccacgaatgattaagggaatgttcgcaacctctttataggctgctgcattcttggtctgaagccgatgcgaccctaacatatctccatggtccgatgtatatatcaccagtgcatccggaactgtttcatttagtttttcaatcacccttcctatttcataatctacaaatgaattgcaccctaaaaacagtgccagctgcctggatgggcggttcagttcgtccgccgtatatttcatcgcatctcctgcccacagctgctgcatcagaggttttttcgtaagatcatcctgaaaatttggataatcgtgaaagcagaatccttcatacatcgtgtgaaagggtgcgggacacagactgggtccatgaggttcatcataggataccgtaagaaaaaaatcttcatccttatacctgtccagaaacttcaaagccctgtccgaacacctgtgtgcataggtgaatgcctcatccataccctcttcgtatgaagtttctgattttcttgatttcgtcctttcctcttctgtgagttcttccagataacagcgcatatcataccagtactcgctgtcccagccatcaggacatgttcccagtccaaaatagtcccctccatccaaatgccatttaccgatatagccgcagtgtatatgattgtcattcagtctctgacctatcgttttcacatttgcccccattgcaacagaattcgccaccataccatttgaatgaggaaaggtacctgtaaatatagcactacgtgcgggaccacatacaggctgacaggtatatgcattttcataacgaatcccctccccggccagccggtccagattaggggtcttcatcctgtcatcgccataacaacccagcatatcttttcgtgtagtatctgtcatcagtaaaatcacttgttttttcatactgccttaccatccctttctaaagaacaatttattcatggagcattacgttctttccgcataacccggtgctttgcctcatgtcccctaccaaactccgtagtgtccgaatacctgatgctcgcattccaaatgttttttcatgaccttaaacttcatctgttcgcaaaacgatctgtacatgggctgatgcgcaagattattgtactcatggggatccagaacctgattatacaactcctcctctccggtatcggtgacataagtatatctgtaagaagcatcataaatagaaatattccgattcctgccgcccaaattatagcaggttgacattggcatgtttccttccccctccttaaaaacatctaccccttgtgcatattgaggtttcttaagattcagcatcgcaaacaatgtgggcagtacatctacattgctcattggtcctgtatatatcagaggcaactcctgttcttttgcaggttttagtataaatggaatatgaatcaggctgtaaaaaggctgatccgttttataaagggtttcataatcaccaagcatctccccatggtctgcagtgaaaataatgatggtgtcatcatacaggttatccgccttcagcttattgataatcttaccaacagccttgtctaccagggatacagatgcctgtgtatacttatatgcccgttcaatgtcatccttggccgcatgattggctttgataaaagcatctgcacccttcgtttttctccccaggatttccccaggatttgaaaattccggtacatcaatatccaaaaatctctccgcaaaatcttcaggcggtgtaaaatcatgatgaggatcaggaaatcctacaaacaggaacattggtttatccttctctttatgagaatcaatgtaggagcatgcctcgtctgccagccacattgaattatggagttctgaaggtaccttagaaagatacatatccatattcgggcgcttcttcccggcctccattctcctctcctttatagcctctatcacttcggggtgattcttatgcagccatctgccgtaatgtccatgatcatattcgcagggggcctccccatggcccaacacattttttacataagtaaatccatagtatgaatccgtaatgtcttccgtctccggctccttccaacgatcatagcagcttctaaaaccataagatttatctgccagggacggctctgtatgcagctttccaagcattgccgtctgatacccttcctcaagcagatagtctgccatagttggtatcttatccggcaccccctcaccaaagatatgttctgcaatccagttatttggatcctggcagccattatccctgcgccatagaggaattccatttgatgatacaccatgccccggcacatacatcccggtcagaaaacttgcccttgaaggcatacagactgaattagccgccagatgccttgtaaaattacatccatcctgagcaagcctgtcaatgttttctgtctctgcgtggatgttaccattgcatccaagactgtcataacgctgttggtcagtaaacaaaatcactacattcttgttcttatttttattcatttccttcttcctctctttaaaacacggcaatatcatatattccaaatctccggcttccatttgtttccagaagctttattttaagctttttatatttccctttctgtatatacaccacattttttctctggtaattattacgaacagaggctgccattttccactttttatcttcatagccatacacatcataatcttttatgatacactcccatacattactttcatagacacactccaaggtgtcatagtcaaaatcatcactcagattatcaaatgtaacctcaatgccggaaagccacaaagccttctcaaattctatctgaatttccggctgtttatcctcgatttctgaaagccatagattcggataaccgtagttcctgatatagccgttatttaaattctgtggagcataaatatctgattcatactcaaatacgggcagataccccaccttctcccacaaatattcttttcgcttgaatgtcgcaatgtcaaaatacgtaccctcagcattttcctgccgttcaaacatcctgattccgttaataaattcatctgtagattcatatgaaagattattatttttttccaaaacaacaaataattttttttcatactcaagaccactgaaatcaagtattactgaagtttcattcatgccgcccactacaatctgccttttggccagtcttatatccgggccataattctccgttttagacggtctgtaaatctgatatgttaaaaatgtatctgcatctgctttaaaaaagagcttcatcctgctttttcctggcacaaccggaaagacaaaccctttttctacttctaatctcctccactttcctgtatgctgaagtttccccttaaaaaaagaagttgcagatatcctggctctgctaatcacagactctgcctttttcagacctacaattccctgatccgacaactgcagctcctgctgcagttcctctatataatatcttcctatttcagaaggattttttccatactttccgcataaaaaagccgccataccacatgcctgtcctattaatgacagggtggacataatccgcaccgttcctaatgccacatgagaaaccgaaagacagcgtcctgcagccataagattatctatcccctgcacacaacagcatctaaaggggatctgatagatgccacgtaaatagtaatgcttattaattaaatcatctgaaaaaaagcctccagccgcatgaaggtcaatagaccaccccccataagcaatcgcatcatagaattctgtctgccgggcaatatccttttcctttaagatatattctcctattagccgtcttgactcccgttttccaagcaccgggcttatatattccagatcaaattgttctgcatcgtaatgtgaaccatgcttgatatagtcccagatatggaacaaaagcttttgatgctctctaactatttcctcattatccctaatttgatccttgtctgagccagcctcataataccattgaaaacggaatccatcatatctggcatcattcggtatacgatccggaacggttctacaagcaagtgctctccgaaaccgctctccttcatcctttacaaactcaggaagttcatagtgcattggcctatgaaaatctttgctgtaaaaaggcagtgaactaagaagtacacctctgtctgcggagtccggtgcaatctcctccccccatactgctttgctttccctgccatacatataatctgcgcctgccaggtatcccactgtgccatcccctgtatcgtctataaaaatatcgccgcaaaggcagaatcttttctcacttccacactgcgagccctccacactgattattcttttaccttccatatgaatagcatcaatattagtattcagaaataccgaacaattctcctctcgttccaaagcatctatcaatacagtatgccataaatatacatttccctgcggattcctgtgccggttttctatcagcagctctccgataattccgccttctctggaataaagattaaactccgacgttccagttgcaccacagacatgaaccctgatttccggacttgcattcccccccagcactcctctgttatgaatcaacgcggttttcagaccttttcttgccccctgtatggctgcacagataccaggcatacccccaccgcatactacaagatcaaatttcttttttataatcgggacgcttctcttcatatttgtcaaataccctcactaatagtatagaatttatataagcaacaaatgcaaaaccaataattaaataaatgtgtacaacataaaacaatatccccacttcagtaaataaggccactgccagcagactgttaagcgttacaattcctacagtacaaggtacatgtttcatagcgatcagcaatgcattatttaacgtcagcctgcaattcaagtcatactttgcaatcagagggaaaatatatgcatacacaatccaccagatcagaagaactgaaaataaaacagagcgtatcaaataccacagggcactgttctgggcatttattatccttaagtccaaaaacagcaagccccctgctgcactgactgccagccataggattgtactctttttaaaatgcagtttaagagaagaaaaaaaggaacggatgatatatgcttcttcatttttcgccatccgcaatgtaacgtcatacaaagcggtcagtgcggcgcctattgtaaaaaaagggatacacgtaaccagaaaaagaaggttaagaagaatcagatcacccgctttccccaatatattcataaatctgttatccatatcaaataatttttgcatctattcccctccctattaaaacaaagcctgccatttcaccaaattttcagcctgtttcttccttcttgtaaaaaatcgaaaggcccaggtgcagattgcctccttctggtattaccaaaataatcctgttccagtagaagcggcattccgtccggtgcatcgtatactgtatctgcaataatcagatctcccagtttttctgtgttcacattttctgacagaatctccgtgattccttttggcattgtaaattccagatataccccatcggctctttcttctattagtatttccggatgaaagccgcaattagtatactgctcagtctcctttgcaaatgccctggcaccgtttaaataaacattgtgtttcatataaaccggctgcctgacagaagtataattctcatgatcctgtcccggtcctgtggcagcctttttcacaaactccctgtatgagatggtatgaccgtcatatccattggttccataaaaagcgtttcctgctcttttcccctggttcccaacaaatatgttattaaaatacctgtcgtcccccccataaacaaaagagtatcccgccacttctgtagaatgcggcagatgataaggagttgacctatccaaaatattaaccttatacatccgcccgcatatcatgttattcacaaaagcagttccctgtgcatggttatcaaatccataatccgaagcaaagatattgttatcgatgatcaacggaccatgcgtcacctctatattaccgtctctgtcattttgatacagcagatttctgctgattcgggttccctgcgcctgccagtccatccagaaccctaatgtacaatggtgtatacggttgccagtgatatcagtgtctataggggcatggaacttgatacctgcaatttcccacccaaaaaattcatgctttatgccaatgttatagatatggttaccatggattttactaaacgcacatcccatattgcctacgattccattctgcccacagtcatatattgtattattccttactatatgcgaaccgattttttccctgctccaaccatttctcaaacctgcaaaaaccgcttcaagctgatgctgatatcctgatttctgcttatatctgtaagacagcccttcacctgtggacgcctccttccccagactgaccgcactgcatttcgaatcatggaaaatattattctctataatccaccccttactccaatgggtaccgatcataccatactgctcactggtgggcggtgcccatggggttgcagcatgcgccatctcgaaacctttgacggtaatataatctatccctgttttttccggatagaaacagcatttccttacattaacctccaccagttcacggttggggtctgctccctgaaaattagcatatatggaagtcgtttcagcctcaacctcagcataccattggtacagagtatccagtggattcagataaaattctttatgtccgtcaccaggatatacaatatactcccgtacttcgggattttttacgtcatccagagttctggcttcataaaatgcatttccattcagatacacctcccctgcatgtactttccaacctgtcggttcaatcatccaatcaccgtcaattgtttggatatagggattgtactccccaaacaatttatttgggatcactgctttccacacagtcccttctaccaacgaccagttgtccacgatttctgagcctttaataacaaccttttcccccgccgcagcctgaaatgtaacacgattcagggggtggcttcctccgcgcttcggctttacccactctctgtacgtacccgcgtggacaactattacatctcccttttctgctttttctgctgccctggagattgttgcaaatggtttctcctgagatccttcccacatatctcttccctgcggagaaacatgatattcctgtctcatatatgctccctttctttaaaataggaaagcctctgaatatcagaggctttaacccacacgctggaattttctattcttgaattgctttattccctcgttccacagcattcttaattgtcgtatccaaatcctgtgcatcagctaaatatttttcaacctcttcctttaaaacagcttcatatttagctgcatttggaccagttactttttctgtgactaatgtctggtctggattcaggaacagatccataatgttttctgttgtaaactgctcatcgtcaatctcgtctgcaatcgtaacaaaaagattatcccgcggaactgtctggtcaacaaaaatctcgctggatgtacgttgggtaacctctgctaccagatccacgatgaagtccgttgccatcttggggtcttttgatgttgcaggcacagcatatgttcctgtcacgccccaggtcagacggtctgtagtaccatccggcaccggcattggagcaaatccgacttcatagtcccttgggtatgtctctttatctgccagccagttcaggaaccatgtcccatgcagatacatagcatattttccgttaaagaaaccatcgggctcaatttttctggcaataatatcagccatagttggtgttgatttatctacattctgcatttgatatgcagcctctaatgcctttttgaaggcaggatcttcaaaattcgacagcccttcctcattataaaaattctgtccacctccaagttccataatagcttcgccataccagtacatcggccactgaagatggagcgccccatatgtcttatcggccccctctccttttgtcagcttcttcgccagttcccggtattcggaccacgtcataggaaccttagggtcaggatactcaactcctgcctcatcaaaaatactcttattgtagaacaggccccaggcagttacaccacccggaatggcatatgcttcatcgccgttataagctgcactggcataagatccgtatctttcttccagatcaattcctaattcatccagatactcccctatagggacaattgttcccgccgaagaattcttatcctgctcaatggggttgaaattgtacatgacatcaatctgttttccacccattacctggatcggaagattcacctcatattcctgatccttgggcataatatcaaaactgacatttttccacttctccgttgtctgaagataatccagtgcttcaaccactgcgggattatttaactgatcatggatagaaaccaccagttcaccactgtagcctccagtatcggcttctgattccgtacctgacactttcttgccatcttcttttggctcgtctttcttgcctccgcaccctgctgcgagacttaccgtcatagcagtcattagaagcagggacatcattttccttacttttttgttgtacataccttttctcccttctttctattagctcgttacttttatattaattaccctttgatacctgatgaggcaatcccctcaataaagtgcttctgggcaattaaatatactacaataatgggaatcagagccatggatgctcccgccatctgcaaagcataatttgcactgtactgtgctttaaaggacgctatgcccacgctcaatacctgtttgctcaaatcctgtatatataccataggtcctgtataatcattccacccccatgtaaatgttaaaatgcccagtgctactaacgaggatttcacaagcggcagacagatcttagcatacaatcccacaactccgcacccgtcaatttttgccgcttccatcatctcgttcggcactgctgtaaatgcctgccgcatgaagaaaatagaaaaacctacaaacattgcccacggcaggattggggcccacatggtatttagcacccctatttttttaaatagcaggaactgaggaatcagacgtatctctgccggtatcatcagagccgatatatacagcataaaaataatatttttacctttgaatttcagcttcgcgaaagcaaatcctgccatagacgaaaacaataaactagcaataacaattatgaccgtatttcttgcagtattgatataccatgacaaataaggaaatgcagtaaatgtctttatgtaattggaaaatgtcgggttttccggaatccactgtatcggaaaattgaatacctcggcttcaaccttaaaagaagtcgaaaccatccagaccactggcgccaccattacaatcccgattgctgcaagtatacatgtttttacaattttccctataaggagtgcctgactatgtttgactcttctgctcatttttatcccctccttaatagttcacccattttttctgtccaatccactgaaccagtgtgattacaaggatgacagcaaagaatattactcccgccgctgccgcatatcccatgtcgtaatgttcaaaagcctctttataaatcatataaacaatcgtgtaggacgaagttccggggcctcctccggtcattacttttgtctctgcaaatatagaaaacgagaagattgccatcgtaatcgccaaaaagaatgtcgtagggctgataagcggaaatgtaatatacctgaatttctgtaaaccgcttgctccgtcaatcgatgcagcttcataatatgatctggatataccctgcagtcctgcaagaaagataatcatacagtacccgagcatcctccaaacccagaagattgcaatcgttggtgtcgaccagtctacacttgcaagccatttgggcggattggctattccaatcgcacgcaggatttcattaaccggaccgaattcttcatggaacaatgcggcaaacacaattgccgcagccgtgacagttgtgatatatggcataaaataaactgcccttaacgccccgcgtccaaaaacggctgtattcaatactgacgccaggattaatgccaaaatcagcagaaccggcactgcaataaatagtatcttcaggttgttcataagacctgcctggaagtattcatcgtgaaatacatctatataattggctgcccccacaaattccgagccgtccaatccctcaaacatattccagtcccaaaaacttaagaatattgaataaaacagcggatatgccataaatactgtaaaacctataaatgtaggcagtataaataaatagcctgctatgttttccttgaaatgctttctcttcatacagctcttcccctctctccctttcgtgttaaaggctttccttatgctgtaatgatagcatctgcatccagttctctccatgttgtatttttgtatttcttgacatatttttaggtctttttcctgctctcgacatcctgctccatatacttctttggagagacaccaacacaggacttaaagacccttgtgaagtgttcaacattccggtatccaaccgcctgactaatttcatagattttcagattggaattttccatcagtttccgggcatggttcacccttatgtttttaagataatcgctaaaacttgtgccaaattcttttttgaatttactgctgaaatagctttcattcaaacctgctatgcttgccgcctctgtgagattcaattccgcgtctgcataattatccatgatatatctgcgcactgcctcaaatgtcctctcccccctgttggatgacgttttctcgagataatcgaataaaaacctgttaaagttatacatccagatcgtatagtcattcgcattcgtcagtctctccaacttttcaggaaaggagacattctttccaaaaatactccacatagatgcccccatatttttcagcataatcccttccagatagagcatatagatacattgcttttcaatctctttcttttccatccccctcagtactgcaaataatttttcttgttcctgcatcagtgcctcgttgtcccttaccctaagagcattcagaagaccctgaaaaaaattcttttcgtactcaaggtatccgaaatcaagaagtttctcctgcttgaggtaaaccctgtgctccccaaatacgtaccgcaggtttagcagtgccatactctcctctgttgcttctgatatacagccggcaccttttctgactgcagatgcactgacagtcacctccagattcatataatttttcaacaccgtctgtatctgtctgcaaattcttaagatatttttttccaccagcatttcatcatgatatctgaggataagacaagagtccgtatactctgaatgttcacaccgcttcgacacccctggaatctgcaaaagcagttcttccattggccaaatcaaatcctgccgtatgtccttaaagcgcccctggagcttctgttcatcagatacatcaacctgtatgatggaaaacatatgtccatcatcataaaggtctgtattccctttcagaaaattatcgaggacactcttcttccccttcttatttatcctcacacacttttcatccaagtccttgtgtatctttgtcagcaactcacacagatgtccctgatccagatgcgattttaaaaggtagtcttctactcccagtttaaatgcatctctgaccagttcaaattcgtcaaaggaacttaatgctacgatcgtaatgtcttgattttctaactgcttaatcagctccagaccatccataatcggcatcttcatgtctgtaataagcacattcacatcatgagaatccagaaactccaatgcaagctttccattttttgcttcgcctacaatttcaaagcccagagattcccaattcacgatatctttcagcgtggcgcggattaccaagtcatcatctgctattactactgagtacacatgcatcccctcctcccatgtccaatacagctttgacatattcttttacaacactgtacctgagttttaatcaattactgaaaggtatccgtatttccacttttgtgcctactcccaggctgctttctatcagaaaaacaaaatcttcaccatagtacaggagaagccgctttaagacatttgcaatccctattctgcctgcttttgtttcatatccatcccttattttctccagtatctcatttgatatcccgcagccattgtcttcaatcacaatcacaataaactttccagccttatggatccccacttttattctgccttctgccatctcatccaaaagcccatgggtcagtgcattttcaataaatggctgcaggacaagcttcggtattctatagcctttgcactgttcttctatatcaatcataacgctgaagttttcagcatatcttattttcataatacagagataagcctccagcatatggacttcatcctccaatgtatgggtactttcaaaatctctgaaagagcaatccagaatctgcatcaaagcatctgtcatttgccggatcccttcattcttagatacttgtgccataaatttaattgtattgagggtattggaaaaaaaatgtggattaatctgcgactgtaaggccttcagttcctcctgatgcctcgcatattctttttgctgattgactgtcacaaggttctggatcctgcacaccatttcattaaactgcatttgaatctgttgtatttcatatggtgcttctgtatttatttcaattgaagaggccttcagatctaatgcctgcatctccttggtcagagtggcaataggaagcgcgagcgtattaaaaaagccccgtgcaaaaagataaaatacaaaaaaaataatagccgatataagcagcatgaatccgatattctgtatatactctctcaaaattagccctttatccttaattaatatcagatgccagtctgtaccatagattcttgtactttgtgaaatcgtattccatatccctgatttgctctgcaagtcctcagcctgcccgacatagcgttcatctgacttaagcaggacattccccttatcgtctgctatataagcactgtaatctgttccgctcagcccggctaaagaatcgaagatagtgcagccctgtaccattaaaaccaaatccagctgttctttgggatcatatctttccggacttaccaaaaaaagcaatgcctttttgttctgccccgatacattgggtataaaatccgcagcatctgcaattgttacatgtactctgtctgtgcctcttttagtttccttataccagaagcattcttctatctctgcttttgtcaagcttatataagtcctgtatccatagctttttccattattaaagtaaaattctatcccttcaacattggaatccggtgttgtcagatagttaaaccgctcttccatctctttacgcttattgtaatctatcgcaccttccacctcggaatactctgacatcatcttaagcatttcattttcattaatcagaagaaactggctcagcttcatggatccctcactgatttcctgttccagggacgtctcatagctgcttagcataacatccagattctgtaattcatttttttcgatttgatgaatcagcaacggaatccccattgcaattaataacagaatcggcagaaccacaaataaaataaaccttttaaaaaatattttctgcatattctgcctcatactcaatcttcctcccaagtatcttcaactcccctgacatacacgtaatatgccccgatgctcctgccatcatccatgaaaaatcttgttctgagatgagttgctcctttgggtagtttcagcctgaaagttacacatgcccacgctgcatctgcctttgcctcttttttgataccggcaatacggatatccgcaccaacaatagcatatgcttttccttctgcacattcttcaaatattctttcgttctttggaagtttcccgcaggtgtccccaagtgcaagaccagactcacgtggatatcttctgagctcaaattcatatgtaccttcctccacaacctcaacagcaaagaatccatttgcttcaattccttcccggatacttgtctggctgaagcacattttggtacattcatgccatgcatgacaggtcagcttcaccggatggcctttggtcagatatatggggctgtacctcatcgcttcttccagacgttcatcataccactcttcataatatcgtgtgagctcaattgccagcggaatatgctcctcataacaattatgctcctcataagggtctttttttatgtcatagatttccggaactgcatcttttccagattcaaatgctcccaacaaataaggatttgtctcatttgtcagcggacacacaagacgcatattgttcttcaatactgtataatccttatatttctggggcatatcacgctgcatgttatgtatgaccagcaccctgtcctgattgatatggtcttctcctttggcaagagcctgatacaggctgataccatctatttgtccgggaggcagaagcccgcatatctctgccagagtaggcaggatatccatctgtgccgttatgccgtgtacttctctgggcacgcctaaaagattcccgggagtggtgataaaacatgcatttctatgggcgccttcataagccatccccttcttccctctcatccctgcattatagccctccagaagccttccattttcatccatcacacatccatcggccgttccattgtctccaaaatagataataatggtatcctcgtatacttctttttctttgagatggctgatcagcttaccaatatttttatctacacattcaatcatcccatagaatcgggctcttttctctggtattcccatatcaatgtatttcttataataagccggttcaacatttagaggtccatggggtgcatttgtagggatataacaaaagaagggctgttctgacgagatgctgctgtctataaactgttctgccaatttaaaccagacgtcagtacaataaccttcgaaggccttttctatcccatttaccagatatgtgtcatcaaaatattgattgttccaataatcaggtgtctccccaatcacaccgccgccaaagctgaccaccgtgtcaaaccctctgttttcagggcagtagggatatgtatccccgagatgccactttccaaacatgcctgttgcatatcccccttctttgaaacagtctgccatagttttaagttccggcttcatgtaatatcttccgttgattgtagaatatacccctgctccaaatgaatatctgccgctcataagggcagaacgtgccggggcacacaatggatcggtatggaaatcttccagtcttatgctgtgccgccccatccagtcaaaattaggcgtatgcagccaagggttaccattcacatggatatcgccgtatccctgatcatcggttacaattatgattacatttggttttaatttcattttacaactcactccttctccattccaacctactcattccatctatggagaccggtcttatttcactgccagcctcaaaaattccactgcccgctccattctctcactgttttggataatgccaatcaccacatcatcccccacaaaatcataacactgcataaatgccgcatcagtactcatgtaaatacccacaggcactggcttttccatcagctggggcttatggggatcaaagtcattcgttccatattctttgccatttgccgcatccattgcttctatgactgcctgatcgacataaaaaaaggaggattgatatttttcaatctcttctttcgtcagaaaagttgtaaggtctgtaaacgctccatttaaacacactcccttatatgtgttctcctcactgacaagcacatccagctctcctgccccaatcatcgttaccaatttctgctgacctgtcacaaacgccatatcctgacgctgatagtccaaataaatagatgtatcataatgaaaagcatattcatccggactcattccaatggattccgcaaatttctgcttaaacccggacgcttttgcttccacttcagtgccgctgataatcattgtctgaattgcaatctcctgcttatcgacaatagtatatatgacagcgcagacgagtaccacagctgctgcaatagccagcagatggtatttgtaataataccagtaatattgcatcttcttttttagcgctgcatttttaattttctcacgttcttctttaaattcatccataacaggcataatgttacctcctaaaagtagtataaatttgatgaagtagttgctttacatttattgtatatccttttttagattttatcaagatttttgtatacaaaatcaggtgagcgataacccatgacaatgattacctttttacaagaaatagagtagggaaataatggctagcattatttccctctcattgaaccgtacgtacgggtctcgtatacggctctacaacttatattccaacttatcttagataataatttaaaggattgagcaaaccagctccgtcctttatttttgtttcaagcaccattgggctaatgataaaattaactacgttcattccactctgtctgtaccatccaagtcttgagtttgcaactttatagattgattcatggtcgaatccacattcatattttctattcatatagcatagatttttatatatggtcttggacgttttccattgtttcatcacaattactcgaattttatgccttaaccattgtccgaaatcatccataaaacctttcatcattccgattctgaaatagttaatccaacctcttacaatctcattcactcgcttaattgttaccgcaagtggtcgggcaattgctttacttcttttgaggtattcacttaatttcttctttagcttctttttcttttccgtggttggttttactttccattcaccaccacttttcagaaatgtgaagccgagatacttacttcttgtcggtctgactacttttgtttttgtcacatttacttttaggaacagttttcttcctatccagtctgtaatggatttcattactctattggctgccatttcacttttcgtgaataccattgtgtcatcggcataccttgtaaaacgaagtcctctctgttctagttctttatctaacttatcaagatatacattagatagtacgaccgaaagtggaccgccttgcggcacaccgctccttgttgcttgctccagtcctttttccattacccccgctttcagatatttccgaatcaggttcaatgtggtactgtcgtttacttgttccctaagaatctgaatcaatttgtcatgatttactttatcaaagaattgctctatatcaatgtctattacccattcatatccctcgttcagatattccaatgcttgttttatggcatcgtgacaacttctttctggtctgaaaccatagctaaagtcactgaatatttcttcgtaaatttctataataggctgagcgatcgcttgttgtatcactctatctaagaccgttggaatccctagtggtctctgctttccattatcttttgggatataaaccctgcgcactggctttggcatgtatgttcggtttttgattgactgaatgatcctgtttttgttttccttgatatactcaccaagttcctcgactttcattccatctactccacctgcgcctttgtttgccactactttcttataggcactgtttagattttcccttgatgtaatcacctctattaattccattgttgttactcctctgattatcacaaaatttatgcacatcatccctctcgatataaacagtattcctcggcttacgttcctacttttcccatccatctgatttctgactaatgcatgattttcttaataacgatttgtactataaatcgtttcagtccttcggctttcacctactatgacatcatctgactccctccctaaacctttttcgtccacatctattgatgtgtgggtagggcctcccaagggtaaggcactaatctttcattccacaacctcttgatttacaacttcggttatacgtttacctttcgggctttggtttgatgtgcaaccttacccacctcatcgccttatcaagtttctgttcgtaggctcgtgaactttgctatgcgcttccttcatccacatcattactgatgccaacttgcgctccgctacacttggcggtaaatacccgtgactagactttcactagctagattagtgccatgcctggcacacacattaaaaacgcagccgtttccgactgcgctctctgtatgttattcaattttattacaacaaacttcgatattcccgtgccccatataacacgcgcatgattaccacctgtttttgatccgaatcaaccagatagaagaccaggtagttttccaccaccaacttgcgatatccctttcgggcaaggtaaatgtcatctacctcgcttccgatatacgggaattgtacaagctggctgatcgagttctccatctcttccagcagtctttccgccgcctgtggatttacaagagttacgctgatgtaggtgtcgatttcatccagatcttcataagccagcggtgtaaaacgaatctgaaagttctcattctccatgcttttgtctcagtctttgaaagacctctttcccttccagaagggggacaccatcctccatctgcgcctctgcggcgccaagctttcggtagacatccaaaactcccatttgcttatcataggtatccatgctcataacaacgaggtggccgctgccgtttttggtgataaacacaggctcatttttctggtagcacagctcagatattttcccagtgtcccgaaggtcggccatcggacgaatcgtaggcataaaatcagctcctttctcgcccatagtatatcacaaagatcggtaaaaattcaagcattattatgccttatcttttttcaattcatttccccggcaacagttcagacaagaccgaactgctagtttccccgaccattttattgggatcgccgccaccgtcaattacttcctgctctaccggacttagtgtaatccagccttcctccgaaaatatttttcctgccccttaaacacctccagcaaagccagtatattctctggaggcacatcaaatgcaagtgcatgggtcggagcaataatctgacctccccctgtatgtaatgccctgtatatccgaattgcttcctcctttacctcctccggcgacgcaaagggaagaacctgctgggtagatatcccaccccaaaaggtcagcttatcaccatatagttccttcattttataaatgtcatatacttcaggctgaaatgtctggtaacagtccagccctatttctatcaactccggaaacagctcatgacaatctccgcaggaatgctgcatgacaaacagccccttgtccttcactttcttataaagccttgccatctgcggcttgatataatggcgccagtgttcaagccccataatcagccctttctgctgtccccagtcatctccaaaatatactccatccaaatcatattctaaggcgatatccactaaatgacagtaatagtcgccgatttttgtgaaaagcgcttccatctcttccggatatagaatcatattgcacaacgtattttcaatccccattagagaccaggcgcgttcaaacattagaaagccaaatccgtacataataaaacggtcatccttttccttatctgcagtaagctcctctagttctttcctcaatcgcaactcatcacagacaggaaactcataagtactttcctccaaatcctcaatctgatattcatccggaagcccaatatctttatcgctgccatttctgttccatataacgccaaactcatccttgaaatatcccggcttcccttcaatttctgttggccatccccaatactgcttatagtgcaagtatgttcccagtttactttctatatctggatctttcgtaaaaataatcagctcctctaatgcctgctcggtaaagtccatatggtacggaacaggaaatgtttccttatgccgtaaagtatttataactgcttctcttctggtcattttttcctcctttttaagtgtgggaactcttaaatttgcaggtatacatcccaactatgccgctttttgtatacacctatttcttctaatttacctgaatttctattgcatccgaacgtgtatttccagattttgcataaattcctatccgacctttctccttcccctgaacaacgagcatggccaatccctgataagtcataagcttaagatttttatggttctgcacatttgaattatctccgttgtccgttccgattatgatagccggtccctctacaacgaactctacttctgcctcttgtgtccgtattctttgtcctttttcatccgtaagaagcagctccaaatgaattgccgaatctatgtccgcctgtagattctttttatcggcatgcaggataagtttttcaaaagatcctgtcgtactgcattgtgcttcaacgcttttcacaccagttacaccaacagcccgaagagtacctgcctcatatggaactgcccatttgtaaatatgatcctcaaattcatccagtctatgtgttcccaagtgcctgtcatttaagtacaatgctacttcctcacaattgctgtacacctctattaccgtcatttcttgttctgtataattccaatgttcatttacttcatgccagcgccacagtcttcttttccagctgccctcttccttttctgccaaattcccgttttcatccagcttataaagagaatcactgaccttctgtgtcacaatatgtatatacggatcttcccgccataacgaacgaaacatatgataggatgccctggggttcccattcaaatccagcagcccatttttcatggccttctgaggccatccacaggattgagcttctccgatgtagtcaattcctgtccacaaaaaaatccccggaatatactctttttccaatacgtgtttccattcatgccactggcctaagttttccgtccccataattggtttgtcaggataattcttatgcccatattcgtaaactacctgccggtaactgtagcctacaatatccagcgcatcagtatagcctgattcatagctggcacttggcagaatgcagtttgctactacaggtctggttgtatccatatcctttacccatttagaaagcctgtgtgcagttttattcacatcatacatatcccgtggcagtcgggcaatcttctctctgatctgttcctttgaatacggaggcagtgtccaaaaataattaccgctggcatccgcattaaaatatcctgttgcctgattgtattttggatatgtccattcaatttcatttccaatactccactggaaaatgcctggatgattgtaatcccttctgattacattctgtaaatcctgctgcgcatagtctttaaagaattctgtatagcctcttgttatataatctacagttttttccgtgccgttttttcgcttatctttaggattgtcccattcgtcaaagaattcttcctgcaccaaaaaccccatttcatcgcataggtctaggaaatcttcagatgccggattatgcgcagtacgtatcgcgttgcacccgcactcccgcaaagccaggagccgccgcttccacatatccaaaggaaccgcggcacccgcaagccctgcctcatgatgcagacagacacctttaattttccggctgcgcccattgagaaagaaacctttgtctgcatcaaaatggaaataacggattcccgtccgttcctccatcacctgaacctccccttgtacttttgcctctattcttacactatataaatttccttcatggatatcccaaaactttggttcctcgactgtgagttcagcatctagctcctcacgatatcctgcagctatcatttttttgtacttcttctcatagagcctttttccacaaggatcagtaagtataacctttactttcgctgtagattcaaatgctgttgtattctccaactgcacattacaatggattactgcactttggtcacccttcacaacaggagtcagcttcacaccccataccggaatccggactttcggaagaatatataaggatacctttctataaattccggagccggtgtaccatctgctgtccgcatatctggtgtggtccacacgtactgctatgacattcttctccccacagggatttagataatctgtcaattctacaagacatggagagtagccatagggatgaaatgttacgagttctccattgcaatatatacttgcacgattatatatgccgtcaaaattaatgaaaacggtcttttggcacatatcttccgatgtaacgaatgtttttctataccatcccaagcctcccggaagataaccggtacatgcctctgcttcttcagagtatccgcttgctatgctccagtcatggggaattcttacgttctcccatccactgtcatctatgtctgtttcatgtggggacggaggctgctctaaagtaaatctccatccatcattccatacaattcctctcatagttcttcctttcccgtatatactcaagttattagatgccatacagccaatgataaaaatatgagtcctcacccctttttatccgcagcttcattcatacattgtctttgtcatataaacttccttctgccattcattaatatcaaaccggcggatatagccataccccttagtcacatcatggcaaagcccccacctcatgccttccaaagggttatcctggctttcccctgcgcggaacggtcccgatgcctccggtccgcccttaatcacggattttatttcaaagttgattccgtcttctgcaaactggattgtattcttctctaccccatctgtacgcaaaaatgctgcaatgccacccgcatacttccagagacaagtctcatggccactgttcgtaatcggattgtattcgctccttgtataaggtccctcaatcttctctgcaatggcaacgccccactttgtctcccttccgcccatatataactgctcgcccataggctctcctttataatacagataaaatttcccctgaaatggaatcagcagagggtcatgtactttatggctgtcaaaaccgccctttttttccactaagaacctgttatcttcctcgcctttccacacaccatccattgtaggcgccagtatgggctcttttgattttacaaaggggccgtccgggctatctgaaacagccatggcaatatattcaaagcttctgcatttataaggggactttacaacctgatataccaaatagtacttcccttcatattccaaggcttccggtgtaaatacgctcctatcatcataagctcctgtttcccctctctggactgcaatccctttctcttcccagcggtacccgtcttctgaaaccgcataccagatatcacagtagtcccatggaaataccttggcattgtcatcgcccgaatgaaaccctacatgtttgccagtagatttcgtataccacacatagtaaaggcctcccaccttcaagacactgcttggatcccttctgtgtactccttcttcatatccgattccttcgacatctgattcattaaaatcacaaaaccattcacagctttgataataatttctttccatcgctctctttgttgcactgcttaacttcattttcttcctcctttttgtatactttatattttgttcttctatttttattgtatacttattagttttgaaagtcaatttctttttaatgaattaaggttctgtaccacaagccggaaatcactgaatccggcacatgcagacgctttatttctgcatttccttcatatgataaaagcttcctttcaaagccataagctcttcataggttccaaactctttcatcccacccttttccattactataatcttatctgcatcccggatcgtagacagccggtgcgccactacgaacgtggtacggttagatgagagctttgcaacagcatcctggatctgcctttctgatacgctgtccagtgcggatgtggcctcgtccagaatcaaaatcttcgggtcacgaataaatgcccttgctatagaaattctttgtttctgtccccctgacaagttcccgccgtgttctctaatttgggtattcagcccatccggcaggctctctaccatttctttcaaattcgatgcctccagaaccttctgaagtctttgctctgatacatgttccatgccatacgttatgttgtcccgaatcgtaccgctgaacagaatagagttctgaggaactaccgcaagatgctctctgtatgtctgcaggtccaatacggtaatgtccgcgccatcaatcagtatcctccccgccgttgctcttgcaaatccgataaccagatttaaaattgttgattttccggcccctgaggcccccacaatcgctacggtttcccctgcctgtacagtaaagtttacatctgaaaataccggctgctctgtatccttatagcaaaaccccacatgttcaaatttcactttcccctcgacatttatgacttgcttattagttccagaatcctccacatcctcggacagcagcacatccccgacagactgcactgattcgagcccctttgaaatcaccggaacaagccccactattccggtaatgctcccaacgatagtactgaaataggattgatacatagccacatccccaactccaatctccccctttaaccccatgaaggccgtatagatcagacacagcacctgaaacaactgaaaagtcacccagtttacggagctgaaataagtctggagcatatcaagccggaaccccttattcgaaacacactcaagtctctgctccatcttgctggtttcttggttttcctgtgcatgggcgcgggctacaggtatcatctcaaccatctccataacctgaacagacgtctcctccatttctttacggaattccgtattataattttttattttctttctgaaatgaataataaccagggcagccaccggaatcgtgcaaaggaaaaataggaagacctctttgctctttaccagaacaacaataagcgcaacagcaacattcaccagtattccaagaaccgtaataaaaatctgggcgctgagattctcaatctgttctacatcccgcataatctttgactgaaggcggccggactcgatctccgtatggtaggatatcgacagctgctgcagttttcggaccaatgcgcaccgaagttccttctccacctgacggatagccttggagtaaaaataagtgtacatataatttgtaggaatattctgcatcagcacaatgagcataaaaagtgaatacatcaagattttatgcaccgcattcccctgtggattcgtaaccacattgataatccccgcaagaatcatcggagacagccatgccggcgaacttttaatcaggaaaaacaccactgaccagaataactgcacatatttgccctggtacatccccaatagtgtcctgaaagttctgtctttattttttctgaagattttctgataatcaggtgcataattttcatgttttttcatactccacctcattatttacttgttagtttgctacatatggtgcatttatgtatacattttgatttattatgtttattttatgtatgtttttcaatcaatccgcttcctttttccactgttattatttaaaaattacattctattttttcaaaaagcttgatttctcagctttttttgtatactataattataaatatataaatttagtatatttaaagaaaggaataaactatgtcaagagtaagaggagaggctgttaatctcgcaaccaattatatcctaaaaaaaattgaaaactatgagttttcagctggcgatatcgtatcagacttagaattatccaaagaatttgatatgagccgcacaccaatccgtgaagcaatcatgtccctcatcgacagcggcattctggaacgtactgctacgaaagttgttgttaagtcaatcacattaaccgatatcactgagatacttcaggtacgggaggccatcgagcagaaagccgcctccattattattgaagccgcaggcctgtcagctgctcaggagaaagaattttcggaaattcatatggaattacttcagaacgttacgtccggcaatttttcaaagaactttcaaactgatgagctattccaccggaaattgattgaatattccggcaacagcaggctgttggacattgcagagcgtctctcgctgcagtcacagcgtctgcgctggatatcaaccctgacgccatcccgttacatctctacccataacgagcatgccgcaatacttgaagcactgtttcacaaaaatgcacaaaaaactgactccgcaatacgtgagcattacctatatactctaaagaactatcaggacatactgaatatgccgcaatggcagaaaattgcccgtgaaatgagacatatgaaagtctagtacagcattgcgggagccatttttttaacaagccaaaaatcccctctggagatttttggcatttttacaattctagtctacagttggatctccattaattactgtccattcaatcccccctataaagaagccttcttcattttccatctgcagaaccatgttcactttttcattcttacaaaatcctaacaaagggattttgacgttctccgtgtcaccgcagttgaattctttacatactgttagaaattctttgggttctggattaggccaacaatttttatcatgaaatatcctggctctgcccttccccctgatttttctaaaacaaattaccggcgtttgcccggaagcggctcctggcactaacagccttgaagtaaatacccggcctccattcactccctggtatcccttcattgcaaccggctgtcctgtattcatatcgttccagtcgaagtcttcccgaattgcctcttcccagtattcttttggccattcccttacattgctaatctccataacgctcctgcataatggcacacgggaaatttgcctgccttgtgtcggatagagtacgacacttgtcttcagtcccaattcagaagcttctgccgacagcaaaatttcgtggctcttctcacttgctttcactgctgcctgcagctttccgctaaacattcttctgccacaccctgcatgtccatgatcttttggatcccccgaatcaactgtaagaagtttgccctgcccgctcacagaaaagtgaacaaatgcatccgcatccggtattcgtacccctgagacatctataaggctgcattccaccagaaaaacgtcttctccattgtcagaagcctgcactacaacatctaatttaagttcctgcggctgcaatgccgtcaccgcctcatccgcagcttcttccttcccatccttcagacctgccgcacggagtattcccggttcatacggcacgtcaaagtgaaccggacaaaaccgctccgcttttttaatgcctatgcttttcccattcagaaaaagttccgcctggggaaggttcgtatatacctctacacgtatctcttcgccttcccttcccggccagttccagtgtggcatcacatgtatcattggcttttcggtccacaaggacttgacaagataaaaactgtctttttccatgccgcaattatccagaatccctatgccggaacacagcataggccaaactgattcgccccggtactctatccccgcccacaaaaaggtaccgcaaacaaagtcatttctttccgaggcggcaatggcagcggcataagacgaaccgaaacttgtccgcttcctgtcataagctgatgaatatcctccctttacttctgatacgttctcatcctcataaatccctctgtgattggcggaagctccgctctctgtagcaacaatcggcttatccgggtgtgcctgatgcataagcggatattcctctatgcggtaatttacccccacagcatcggatgcctgtgccgcgcaggaatcataatatccgccgtttaacgccagtgtcacaggacgggcgctgtccatgcggtgaagaaatgccttcatctgcctggctaattcttttccctctaacgtatcctgaagcggttcttcatttccaatgctccacataataaccgatggatggttcctgtcacgcaggcacatatttttaagctgctttttcacatcttcactaaaattaaaccagcggttttcatcaatgaccagtatgccttccttatcgcagatatccaacaattgcggatccggattatggtgcgcagtcctgattgcatttacacctgcttcttttagcttacgcaccctgtattcctgcaccgtgcgcggaacggccactcccagtcccccatggtcctgatgcaggcacacgcccctaagcttcaggccttttccattcaaaaagaatcccttgtccggatcaaaggcaatggcgcggaaaccgaaagaggtttctgtttcatcccacaccttctcatttacaataacctggctggtcaggcgatagcagtgtgtctcttccacagaccataatttcggatgctccacttttagggaactgctatacacattttctccgaacagcgctgtaaagggatactccgcttcagaaactgcttcgcccgtgggggctgtaatacgtaatctgatcctcccctcctggtgttctaaaagactatatactgtgctttccacccgtacctgccagcttccgtctgtaccttctatggtctccgccttggttccccatacatccagcgctgctgcctccattttcagcatccatacacttcggtatatccctgcgccttcataccaccacccctcaacacttttattgctgatgtgcacggcaacaatattgatttcgttttcataaacaagataaggagtaatatcgatataaaagctattatacatactttcatttctgccggcaggctgtccgttcacccacacctctgtcttcataccggcgccgtcaaacagaagtacaattcgttttcccctgtcagattccggaagctggaaactcctcctgtaccatgccccattccttttcaggcttccctgtgactcattatattcttctgacggcttccctttgattacataatcatgcggcaaatctacatcctcaaactcaccgtcatagaagttgggcattgacggagccggaccgttttttgccttcgcatgcatataagtgtcataatgtccttttatgatttcttgtggaaattcaccttcgaagaatttccatccgtaattcatatttaacttctctggcattccctgtccccctctctgtcctgagcaggcaagaactgttccttcaactccgggtactgctcatctccatcgccatactgctttttcagttcatataattgttttttcaattcttcccgtatatgccggtactccgtcttttcataaatattatggagttctcccggatcactgcgcaagtcatacatctcccatcccggaggtgttggacggttaaccgccccttttgcatctagcggaagtccataataataagtgagcttaaattctttcgtccgaataccataatgcgcagggttatcatgattatgtgccagatgcatccaataccggaaatagatgcctgaatgacagttttcctgcttcctccctgacagcatctccctgccggaaatcccctgcatctcatcaggtatcctgacgcccgcataatccaaaagagttggggcgatatcaatattggacatcagttccgtacagacatgtccggaagttatctctttgggatagcggatcactaatggcgttctcagactctcctcaaaactccagcgcttatcctggtaatcatgctctcccagaaacatcccctggtcagatgtatagatgacaatcgtctcttctaagattccttcttcctccagtacccgtagcagcctgccaactgaatcatctattgccgccacggtcctgagataatccttcagatatttctggtacgctgccctgcctttttcttcaaagctcatattctccgttccgtttaagcgtcccgtcacataatccggcttcaagaaatcctgatataagctgcggacgctgcttctgggggtaacagaacttccaaactcacgcgttgcttccgaacggtgcgaacggtcttcaaacaggctctccggttccggaatctccaccccttcaagcagatgctcatatctcttttcatattcccaaaaatcatggggggctttatgatggcacatgacaaaaaaaggacgcgccttatctcttctgcggatactgctttctgtcagatctgtgataatatccgtcacataaccatcgtaccttacaaacccttctcccttcttcttaaaagacgggttaaaataaaccccctgttcgccgaatttccccgtaccgtcggagagatattggtaatcttcaaaacctgccggctcacaacccaaatgccattttccgtacaaggcagtctgatacccggaagactggagcagctgagccagattcgggctgccgcccggatcccaattatcatctaatgtcttcacgccattgacatgcccatactgtcccgtcataatagacgcccttgcaggtgtgcatactgcatttgtcgcacagaaatcttccatcctgcatccctctgatgcaattctgtctatatgcggtgtctgaaacaccgatgcaagaatcgactgatagcagcttatggcattcgcactatggtcatcagacataatatataatatattaggcttcataaattttctcctcttttaccctttaatcgagccaatcataacccctttaacaaaatgtttctgtacaaatggatatacgcacaatatcggtatgatgaccaatatcatagacgccgcctgtaccccttccggaattgactgcacggtagatgcgtcaattgtctgtccagtctgtgaagccatcgtagcgcccatcataatattacgcaaataaagagttaccggatatttggatccgtcattcatataaatcaaagccgaaaaccaatcattccaataggaaactgacataaataaagtcattgttgccagaatcggctttgagagaggcagggccatcctccaaaaatatccaaattgtgacagaccatctatgctcgctgcctcttccaattcatcaggcaaaccttcaaaataagttttcatcagcagtatattgtaaggtgcaatcgcccccggcagaaccaatgcccatatagtatccagcatattcaggttcttaatcaggttatagtatgggatcaaacctccgccgaaaaacatggtaaaaacaatcagtctgaggagtactgtcctgcccactaagcgcttcttagataaggcatatgcacagatagttgtcataaacaaactaatcgcagttcctacaaccgtataaataatcgtgttcttataattaatccagaatttcgcctctcctaaaaggcctttataagttcccagactgaaaccttttggaaatattgtgatatcccccgtcagaatccctgtattactactgagagatactgcgagttgatttataataggataaagcgtcaaagctgcaaggacaatcatcagcgtgacattaaaaacctcaaaaatctttctgcttttacttttcttcattgtcgatccctccttaccataatccgcatccccagcgcttattagttatcctatttgcagcccacaataatgacaggcttatcactccctgaaacagtccaacggccgtaccataactataatttgcattcataaggcctaccctgtatacaaatgtctggatgatgtctgcagtctcgtatgtcgttggagtatacataaggagcaccttctcgaatccaatattcaagatattgcccagtgcgataatcaggttgatggcaatggttggaagcatcattggcagcgttatatgaattgcctgcttaatctttcccgccccgtctaccattgcagcctcatactgctcctgatccgccgaagagagtacagccatatagataatggaattccaccccagaaactgccaaagttctgaaatgatatatataatccgaaaccagaagggttcgttcatgaagtaaatagcctccccgcccaacttctcgataatcgtattaacaataccggttgaaggcgacagcagcgcattcatcatggccacaactacaacaacagacagaaaacgagggacaatggtaagcgactggacaaccttctttacctttttctgcataatttcattcagcagcaatgaaaaaagaattggaatcgggaagcatattaacaggcttaatccacttaataccactgtgtttttaaatacgttccaaaaagcttcgtcctttaaaaacatttcaaaataccggaatccttcccatgaaacaccaaaataagactgacccggtatgtattttcgaaatgctatgatgtttccaaacatcggaacatatttaaatattataaaatagacaattggaagcagaagaaacaaatacaacgtcttgttattacgtaaacttttccccagctctgcggtctgcatacgaaactgatttttattcttcctattcataaattacctccttagacgttggcacttcgtctttctgcaaacaaactctgcagatatccccttatatatacagaatgcagcagtccacatttttcaaatctggtactgccgcatctgcaacaaatatagacactgtgccttatttattatatgacctgttcattcattgttttgaacagagacattattacctacttacctctggccgcccatgcttcattgtacattttttccatttcagtgcttcccttgttctcacactctttcacaaagttgtcccaattatccagagactccgtaccgaaaataaagctttccatcatggacttcacataatccaccagagttgatgaggtaacagacagttcgtccatctgctcagtcgtcagaggagaagcaggattcgttggcggaacataaccgttctcagcgcatacgtcatacacatccagaacctcctgtggcagtgtgctggcgtagtagtctgtatcaagccttacacagaagttattctcatacaggccataatcagaattatacttcaccttatcatccatgaataccttcttaccgtcctctaccttgtaagtcacaccctcttcgccaaaggtcattgccgtcattgcctcatctgaatacagccagtcaaccattttcagaatgtcttcaaaattatccttttccgcaactgtggccggcataatccaggcctgctcccacggtccgttccactgaagcgcatattcaccctccagtccttccggcggcgccatagctaccatattgaaattctcgtcaaatggcgccccttcctgattgaactttttacaattagttgcccagtcatacacgataaatatttcgccctttgcaattctctgctcatatacagatgaatcttgtgtggtaaattcagggtcaagcgcccctgaagaataaagtttatttgcatattccataaactgtttccacttatccgtggtcggagagaattcccacttatcttctttttcgtcatagaacattccgtctcccaaagtccatcctgccagaccgtcaaaagcagcggccaaacctgccatgatattgtcagacttgaaacgattggaaattggcgtagattccgggtaaatctctttcagcttcaaagccacctccataagctcatccaacgttgtaggcatagaaagattattcttttctaagatatctttacgcaccagccattgatgatcctgaataacttttgtcttcgcttttactggaagcagatagaacttaccatcagccattctctgagattccatatacttttccagaccgttgtcttccagatatttctgtaaattgggcagtttgtccatataatcgctaattggaagcaataaacctgacagcgcatctgcagctttcggaaatgttttagtcataatatccggcatatctccggagttgaatacaacctgcgttttggttgcctgatctgaaacaggcacggactgtacattcagcttaacacctgtcttctcttcaatcgttttaactaccatccaatcttctgaaaacggcgcttcggcatcctcgaaaatcatcatagacaccccggaaactttttcttttccatccccttttttagtctcctccttttttccgccgccgcagccagccagcagacccactgccaatgccgttgccagtaaaacactaaccattctttttttcatacttttcctcctttaaatattttaatttcacttcatttgcatcaacattattgtatactttaaacgcgatttagtaaatagtttttgtatacttttcttttattcactgtctttttctacttattgcactaattttaatgcatgctttagtgcatcactcacaaagattgcgtttaaattatccatgtcaataatcagagtcggggcagtccacttagcagctaactctattcgaaaaagaacagtcccactggacaatcaagtataaaaatcttgattcccgtggggctgttcttgttttgtatcaaaaggactgatatccaggattaaccaatggttccttttgcattggatactgtatgatttcttctgttacttgactgcttcatcataagcttcctgtaattggattgcaccttttgcttcacattctgcaacaaatgcatcccagtttgccaaatcttctgttccatagatgaatttttccgtcatagagaacacataatcctttaatgtagaaatataaagacttgcatcttctaaggtatcattatcaaggggacacgctggattagttgcaggaacaactttactgatttcccccagcagttccatttcctctggcgtatatgcagaataaatagcatccagatcctctcgtattgtcagctcattattattaaggccatacttaacacgcgcaacatccggctctataaattccttgatgccgttatcatttacctgataggtctcgccctctttgccaaaagttaagagtgtctcagcctcatcagtaaagccccagtcgagatatgccagcacctcagccaaatgctcttcatcctctgctaaagttgccgggaaacaatatccctgtgaccaggaagatttccatcctactgcataatctccttccggtccctccatcggataaatcggagatacgttataatccggatcaatttgcttcccctgttcattgtaacgaaccttattcgccgtccaatcaaacatgataaacgtttcactgtttacaatcttctgttcatatactaccgaatccaaagtggcaaactccttgtccagcacacccgtttgataaagctgattcgtatattccaggaatgatctgtaattatctgttgtcggcgcaaaagtccatttccctgtatcatggtcatataacataccatcaccatatccccatccgcttgcagtgccaaacatggctgcaagtccctgcagaatatgattggttccgaatcgatttgtgattggtgttgaatccggatataactcctttagtttcatccctacatcaagcagttccttatacgttttaggaatggggagattattcttttcaaaaacatccgtacgtatcatccactgtacatcctgaaaccgctctgtatgcgccttgcacggcaaagtatagtacttgccgtcaggaaaccttgtcttatcaatctcgtccctcaaatcatacttttctataaaggcctggtaatttggcatctgatcttcataatcgcttataggcaaaaggatccctgatgctacatctgttgaagtggcaaacgtatgtgcaacaatatccggaatctcaccggaattaaaaatcagctctctcttagcaacatagtctgacgtaggaacaattgtcatatcaagcgtgacccccgctgcctcctttatccactcaaatacaggccaatccttctgatacggttcattagcgccgtcacaatacatcatgctaattgtaacgtctttcttctctccaccgtcctctgatttcttcgatgtgtccggagatttttctccgccacagcctgccagcattgccgtcaacattgttgcagccatcagcatagcaatcatttttcttttcatatttctcctccttgtaaattcgttttatcctaatcggacaaattggcgtacctgtttttggcactttagaatacaaactaattatttttgttagttttattgtatactataaacatgcttttttcaacacttattatgtataagtgtttgttttttactatatcgctaaaaaatcagatcgttttttgtgcacattttacagctgttttataaagcaaacccgattttctccactcctattctatatcagccaactcaaaccgctcaatataatcccacttagcgcttaccatacaaagcccccactttaatccgtccaatggacgcttacatggttttccatctcgaaacggccctgccgcatgtggtacatgttccaatcttgcagcggttcccattatatcgaaatttatcccatcttttgcatattggattgtattcttctcgactccgtcagaggtcagcatagcagccattccgccgtcatattcccaaaggcaagtttcatgcccgctgtttgtaatcggattatagggggatttaatgtaagttccttcaatatggtcagctacagcaacgccccattttatttctcttcctcctccaaacattccctcccccatagtctcccctttgtagtaaagatagaatttaccattaaagaaatgtaaggatggatcgtgtaccttatggctgtcaaaatcacctttcactttaaccgcaaaacgattgtcactgtcgccttcccatactccattatctgccggctccagaatcgggtgctccaacttcctccacgggccatctaccttatctgcaactgccataccaatggtttccttgactctgcataagtatggactttttacgcattggtaagttaaatagtatttccctttatgtaccaggatttccggagtaaacacactgcggtcatcgtagctgcccgccgccccttttgtaaccgcacagccaacctccctccatgtatatccatccaagctttttgcataccatatttctgcatagtcccagggaaagacctttacgcttggttttccttcaataaaaccttttgtttcccccacgctttttgtataccaaacataatactctccccccacctggatgacactgcttggatctctccttgtcaccccttcctgataccccaggtctccttttaattctttatagcaaaaacgggcatgccacattttatccaaattataatacccccgttctctcgcccggattgttgctttactttctaccccttccatctcatataccaccttccattacggacatcactactttgcttcgttctttctgggaaaccgtccagagcagctgttcacgcagttccgccggcatcttccagcctttatatgccgccagaatatttaaaccgcttaccatccctgcttccaatcgtgcatcaacttgaatatcctgcttctcaagacatcgggacaccaaaatgctgaatatcggttccgcctcttccgcatcccagaatgttatcacatcgacaataaacatcagtaaaacataattttggctgagataacaaatgttatatagcgccctcatattttttcccttaagggccgcacaggcacgcaccgtttcgcttcctgacagcagatactcctctattatcttttgttcccctgtctctccctttgtaaatgtgagttggataatttgttcacatggatttgtaaaaatgcctccgatctgcactccattcattccctgttcccataaagcagcaagttttttcactggataagccaaatcatcctgcagaacttcataagccgtcaatcccagggcatctgtcaattcttgcagcaatggctcgggaatgaacgctgcatctcttaggataatgattttctcaatcagcgccttctgcagtttccggcgtatcttcttatgcgcttcgcattcactgtcaataaggctgtacaactgattgggatcttctctaaggttatagagttgttccctaattcggggcatagaacgaaaaagagcacgtctttccgtattttgtatcctgctttccctgccctccagtatcatagagcggacaaaccaaggagcctggagtatctgataagcattcagtcgctttcgggatgtaaacgcaaaatcaatagtgtacatccactccccctcatgtatacttctggagttttcaaacacttcatcttccctggcgcaaaaagaatacaccctattttccgccgctgtcttgtgctctcccaaaaatgcatgtccctgcatgttctcggggattgcggctcccgcaacagacaaaaatgtaggtgcaaaatcaacaaaagttactttcctgtcgctatactttcctcgtggatcccttttataatccacctggttttccaactcttccggaacatgcataagcataggaacatgcacaccttcattccagaggttaattttaccttgcggaattccgtgcccgttatcgcccacaaatagaatcaccgagttttcataaagcccgttgtccctaagtcctgctatcaattctccaaacatacggtcgaaagatgtcagtttttcatgatactgcgcccaaatttcctttgcatctgccgtatcaaaatgatatcctggaacctttaccgcctctctttcctgatattcttcctcctttaacctcggcatagatgctcgatgttcatccgcagcattggtataaccatactgagattgatgcgtaattgcactagtttgaatcataaaaagcggcttatcctctggtagattctttgcaacattcaggatatcgccggcaaaatctaatgtgtcccgataagtataatctatctgttgatcatatccttctttcagcgggaagttaaaatccgttttaccgatcacggtataataaccagctttctgcatccattcacctatattccgaatggatgatggcaaatcatacatgctgcggtgctgcccaactcctgccgttgtaccgtacatccccaaattcagtgacgtacgggccgccgagcagacaggtgcggcagaatagcactggctaaaacggtaatttgttcttgcaaaagcatccagatgcggcgtccgtgcattcggatcgccataacatcctaagtttgggcaaatatcttctgccataataagtaaaatattgggcttcattatttttactcctcacttatgtcggtcttacaggctatacagcttatgctgtaagtaccgagccttttaatcaattcttctaagcaaccctgaatcagagttttttattttgaaaatattctttaaaagctgttccctgcggaaacattggataagtctgccctcatatcctgcaagcttcccctccagagccgcttcaatcaaatgcgcagctgtaagtggagactgtccccgtccttctgcaaatgccctctcaatatcgggcatgtaggttcgccctgctggatctctgcacaaagcttccgtacgctcatttctcaccagccccggatttgtacaaaaaatctgaacagaagatttctctttctccaattcaagcgcgactgactctgtaaatcgcgcaacccctgctttcgccgtagaatatgccgctgcgtataaatgaggttttgccgccccgcctccacagaaatttaaaatcaccccctgattcttttttaacatatactgcaatgctatatgcgttccatctacagcgctcttgagatccacttggatctccgaccacagatcatcaggctgtaattcccagaacttcccaatggctttattttgcccggcacaattcacccagacatcaatctgtccaaaccggagaaccacatcctttgccattgcctcaagcgcttcatactctgtagcatcaccgctataggccaacattgtcccgccctttttttgcgcctcccggcaaagattcgccaagcgttctcctctgcgcgcaaatacacagacaatggcgcctttttctgaaaaatagtcactcatagcggctccgattccactgcttgccccaaccacaatgatgactttatttcttaaaatctccatcattctctgacacctctcgacagtacatacgcatatcacaaatacgggctttctcgtccccatatgtttttagtatcgtcaccctggttcttgtacatgtaactttttcaaaacattgtttattcatgcgaacacaattatcctttattatcatttcttttactaattcttcctgattccaaaaactgattttataatcccgcacaagttcacaaggcatttcctcataattcctatggctatccgttatccttgtagaaatatacttagaaaagttaggatcaaaacgaagcagaatttcattcacttccactgctttttcaaaaataacctcaatccacccgccattttctcccataggctgagaaatccacgcattttccttctcccctattcttcttgtgtatccactattaacccattttgcttcagccccacttaatgcgctggaagcctgaatgctgcatcttgtatgtgagattatatcttgctcatcatcaatctcaatgcctggaaggtatgcatcatcatgcaataacaattgctgcaattcatgcatatatttattcacgcctctgggcgtgactccatacttatgggcaacagcggccgaggttccaacggcctgcccgataactgcgcatgtcccaatcacccgagtagaactaagcgccatatgagaaacactgattgcgcgaccgcccacataaaggttttctatattacggctatagatacatctgtgtggaattgtataaacatcttctacatcatgccacacacttccctgaccttttttgttttcttcagtctttgccctgataccgcctatcgtgtggtcgtccatagtccacccgccgtaagcaatcgtatcctcaaagcggcaagctgcatcaatatcgttttgattcagaacataatccccaaagatccttctgctttcacgcttgccagggacagaaccaatccaatccaatgcaagatttgccgcctgtggaaagtccccactgtttttaatataatcaaatacaccatagacatatttaatcagttctttatgaatctcctctgcatcttctattgtagataaactgtcccctcctacttcaacccaccaatatccattagacagttctccaatatcacgggctcctatgtcctttgcggtcagtttatatgcccattttggtcttttgaacacaactggttttcccatatccttcgtagtatataaaatggttgaacccattgttcccgaatcagcctcatccggcgcaagagactcattataggctgcttttgcctctcgtccaaccgtataatccgcaccactttcatacgccaagttggcatcccctgtagtatctgcgaacaatggcgctttcattaaataagttaatcctgtcgtattctgataagcttcaatactctcaatacggttatttacagttacggctgtacgcatggaggtatttaaatagagatctatattctcctcatcctccaccatttcccacgttacattatccaaaacatgaaaagaatactgtggatttacctttttatttcgaaggattaattctaaaacaagacctgattcaattgcatttttatagccattgttacgtcccgctccattaatactcactctaacttctgaactggcattgcctccgagtacaggacggtcatgtattaatgctgtttttacaccattacgtgcagctgcaagcgccgcacacacaccggatattcctccgcccactacaataaactcatattcttttgctatctctttcattcgtctccttcccggctcccgctttccctggataatcaccacttaccctttaatagcgccgatcataactccttttacaaaatgtttctgcacaaaaggatatacacagataattggcgtaatgacaagcaccatagaggccgcctgaacactttgtggtatggtctgcattgcagaatccatatctccgctttgtgcggccatcgttgcgcccatcatcatattacgcagatataaagttacgggctgcatttcctgatcgttcagatacatcaatgctgaaaaccagtcattccagtatactacaaagataaacaaagtaatggttgcaataattggtttcgacaacggcagcgctattttcataaaatatccaaactgccccatcccatcaatcttgcttgcctcttcaagttcgtacggcagccccataaagtatgtacgcatcagaagtacattatatggaaggatagcacccggtaaaataattgcccaaattgtatcaatcattcccagattacgtatcagcacaaaattagggatcagcccccctgcaaaaaacatggtaaatacaatcagccttaaaagtattcccgacccaaatacatctttttttgagagggcatatccacaaagcgttgtcgcagctaaacttaaggcggttccgaatacagcataaataattgtatttgcgtaattcttccagaatattctttgttcaatcaatcctttgtatgtctccagagtaaaatctttgggaaagatggtcactgtagacctcagaattccggatgcactgctcagggagattgcaacttgatttaaaataggatataaagtaacaatcaaaattacacccaacaatccatagttgaaaatatcaaacactctcttgcttttgctctttttcatatgcttctatccccccttaccaaagtcctgtattccatcgtttgttcactactttattagcgatataaagtaaaaccagtccgataacagcttggaacaagccaactgcagtaccatagctgtaatttttattcaaaagacccattctatacacaaaggtctgaattatatcagaagttgcatacgtgcttggcttttgaatcaacaatgccttttcaaacccgagatttaagatatggccaatagagataataaagtttattgatatcgtcgggatcataataggaagcgtaatataacgtgtctgcttccatcgattagcgccgtctatcatagctgcctcgtattgttcctgatctgcggaagccaataccgccatatagataatagagttccatcccatgaactgccatatgtcagttataatatacacaggccggaaccatcccgcctcattcataaaaaaaatctcctcacccccaaaaaattttacaatctcattaaccacaccattagacggtgacagaagcgaattaaagatcaaaacaacaactactaccgataaaaacttaggaacaatagcaacggactgcactatttttttataccccttatgcccgacttcgttcaacaaaagcgcaaaaatgattgacagcggaaatgtaattattaaaaccatagcacttaaagtaatcgtattaaaaaatacactccagaaattttcatctgttaaaaacatctcaaaatacttgagacctgaccattcttctccaaaataattgccgcccgttctatactttcggaatgcaattatattccctgccataggaatatatttaaataaaacaaagtatagtataggaaaaaccaaaaacgcatagatcactttatttctagaaaatgaatacataaatcttttacctggtcctgtgtacttctgtctcttatttttcatataactcctcctaacctcatgtttgaaacccggactttgacacactctgcgtcctcctcaactttaacaactccctgcattttccctgggaaaatcttcgtactccactcccaatctttttgatcacctgcatccacagaaataagatttcctccttccatcacatcaaatacattttttctgctttgttcattatccgcttatcatcatccagcaaaaaggcttctaagatgggggcatactctccattttagtttttcccgcataatctctcctatcattatcccagattaaatgtaagttaacgtctacgatacaatctcaacaattgtgtcatataaaatatctgcgctgctttttccgagcatcaatctgacatgccccttttccaaaacaaaattcatatcataatcataaatgcgcagttcctcatcccctacactaagtcttacctgcctttcttctcctttttcaagagatacttttgcaaaatccttcagctcttttacccgtctcgtaatacaagattccatgtcataaatataaagctgcaggacttctttgccctgtctgccgcctttattagtgatagaacaggtcatttcaaatcgttttccctgttccaattcttttagggacaagcgctgcgtattcagcttgaaatcaccacagacaaattctgtataactttgtccgtatccaaatgggtaaagaggttttgcgctctcatcaatataatccgtctcatctttacgattatagtaaacagggagctgggctgaagatttgggaatactcaccggaagccggccgcttggatttgtccggccaaatagaatctcgccaacagcatcccctcctctttcacctggataccatgcacaaaggagcgcgtctgcattttctttcatccaggacactgcatgtggacgtccctctatcagcacaacaatcagaggtttcccaaacttttttatttcctttgccaaatcttcctgcacaccgccaagacggagttctgcaagatcaacagcctcaccgcaatttaattcttttgtaaatgcattcataaatactgccccattatcctcaaaagtcattccgggctctcttgtactgcttccgcccaataccataaccaccgcgtccgcgtcttctgcaagggagattgctgatggaaacccgtctttgctcacatccctaatcccgcatcccgtggcaaactctatggtcactcccgatggcgcctgtttcctgagaccctgtagtacagtaacaacttccccctcttctttccactgtgtataatcacctaattggttatacaccgaatctccatttggtccaatgactgctattctttttatttctttgccaaacggaagaacatctcctttattttctaataaaacaaccgactcacgggcaatctctaaggcagtttcctttgcttccttcgaacctatatttagtaatgcaggtgtttcttccacatatggattttcaaataaccccatcctaaacttcgcctccaggattctcaataccgctgcatctatatccttttctaacaacggatttttgcgaacagcattttctaacttcagaaaacactcattccacaaattcaaatccactccggcatgcacagctgcagcgcatgcgctttcatacgaaccggtaatgttttttgcccgatccactccccggccatccgacataacaaatcccgtgaatccaaattgttctcttagtattcccgtaagcagtgagcgattgatatggcagggcacgccgtcaatgtcattataggcggccatgcagccaagcgctcctgctttcgccccttttttcattcctggtaaatgaatctcgaataactccctgggacctatatttgttgcctttccgttgtgaccgccgatagtagctccctgcgcacaaaaatgttttaaaaccgagataaccctatccggttgtgttaacgcatctttgtctccctgcatccccagaactgctttttcacaaaaagctgcagctaaaaaagggtcttcactgtagcactcttctgtccgcccccatctgggatccatcgcaatatccaatgccgaaatcaagccaagatgaccgcctcttgcacgtagttctctggcaattatgttgcaaaccttctcgtatagctctgtattccatgaggctcctatccctatattggttgggaaggtagttgcctgaagagcttcatgtccatgcgggcattcttcgctgagaaagaccggaattccaagccttgtgttctccctgatataacgctgaatcgtattggctacccgaacactgtccctcacctttatcccgcttgtcagatgagaattccagccgtctgcccgaaacaccccatatatagcccctacgccatcgccaaacgctacttcttctgcaaaagcttctgtaagttctactgtttcgccctcaactttatatgcattccatccgtgcatcttctgattcatctgcccaatcttttctttgagtgtcattcgtgagagcagatcctgcgcacgctctcctacgctcaatgatgtattcatgtatttcgtggtattcatttttattttctccccgcattcaaaacagtgcacttttctgcgtatatttttaaatatactctttgagccatcaagcatatgcatcccattttgttttttattttacgtcattatttattattattgtatactatttattttgttttggcaatacttttattcaatttaaactgcttttttgtttcaaataaccatttcttatgtaatactgacaaaaaaaattgactttatctaaaacctttcataactaatgcttagacaatccccagaatcgagtaggagggagtgattaactcccgtcctctcacagcaccgtgcgtaccgttcggtacacggcgctttcaatagttgacgtgcacagactgataggctgtggctaaatcataaaagccactgtttatcaatctctcttttgtcattgccaggttgaccgccacggtatgcgtcacaaaccagtatcctctgcgactattccccgcctgacatgccaaatccgtcggcactcccatctttatcagatttcttaccttcgttcttggtttcttccattgtttccatatacacatacggattctgtgatatagccatccattcaggtcatctatcctattcttcatatctgcaagcccacaataattcagccacccacgcatgtatacttttatcctctgttcgtcagaccaggggtttgcccatgggtttatatgttccccatatccagcttccttcagattccacctcacgatggacacccttgccttcggctatatccttcccactaccgggcggattcaggactttcacctgttagaaacgtgcgccgcaaggcacacatatacataaagggcgtatgcttacgcatacacccttatacctatatttactattttttcaatctcttacggagcaacagcatcagcagaactattgctgataaaactaacgccacaactgctacaaatattctgctttcatctcccgttttaatgacatctggtttctttaccgtttcactacctgcattttctctgatggtcactttcagccggcagcttttcccttcataaactacagtcaaatatatatcaccgcttttgctgctgtcaaatcccttaacctgataccctgaaatgagctcggtcgtgccatcctcatatcttgccataacctccatgcctgtaatatccagcttttccccaacctgatatatctttttattgggttcttttgtaatttctatcgacaccaattctttatcatccgtttccccgccgtccggtttctctgacctttttatcgtaaatgttgtttctgctatccctgatttggaaacaattgcaatattgtacactcctgcttcaagtccgtccagatatgactcttttaaagttacaacagtactgccttcgctcacttcatagcattcactgttcaaatcagttccattaactgttaccttaataaaatctgcaaataaagcatccgacttaatgatcagatttccttttgtaccattatcccaaacagcatttgccccttctataatttctggttcctcaggcagtttgagaccctcgacaattgttgtatcaacgtctggtctttccgctttaacaagaactgttggttcctcatcctctttaatcacacaaacattatccaagataaaagaaacattttctttatccttcatctccatatggggttcattaatccatatagcaacttttgctgcattcttaaaattagctggtgcagccggaattaactctacgtgtttcgtttcacctgctgcaacctgcagccagttttgtgtaagtcccccttctgtatcgtatatattaaccgcatagtaaagagtatactcatttggatttcctatatcaaaagtcaaatgattagacatcaaatcccaatactctccacccgcagctgtccagacaacctgagtaagatcgttccatgagcccatcttaggaactgtaacctttaaaacactattattattttctgttataatttcactctcggcaggttttccattcgttactatataagaaacatcctccccctcttcaaaggtcgtgtcagggaatacggcagcttcactttctatcaccactgcatcctttgaatttttcgaaaacattgtcattgcagtatctaaaatctttaattgtgtttgtatttctttgtcggtacgcattacatccttcaataaggcacaagcatctgtaattacattcgtaaaactttcaaaattaatttgggttatccatttagcgccagccggcaaacctgaaccgtcttccgaaagataaaggttatcaccaatcatgttcaatgcttcctcgattttcaccttcagcggcgctgcgtctgcacaggctgctgctgctttatcgtaattattaataattgatacacaagatacgcgcccgccttccggcatagaaacaacaattttattggttccttcctttacctcagcaggatctatatcaaaatctgctgtagtgaagatatctccggttttattagtatattccaaatctctgttcccaactactttgccgttgagagatatggtcatagttccggcgaaaccacttcctgacttaccaaatcctacccgtattgtcgaatcaacaaggtcactcttagaagattcaacggtaaattccatatgatttcctgtttcaaccaattcttcccgggcatagtctacttctttgtatacttcacttacaaattcagccgcatctgatactttaatttcaaacattgccatttcctgtacacgcatatgaatatcatttaaatcatctaccattatttcttcataggtaagcttagcattttccaaaaaataatgtttttcacttatattttctatttgaatcccattccctaatataccctcaatatcaagatttacttgctgattatttaaattttgaacagccagatatatggtatctccctgtctgacagcctttgtataaatacggcttttaagtaccggatcatctgtacttatggatgccggtataaaggcgccattaaaatcagtccacatatctacatatgcttccaggggagtcatctcctcaagaatgcctgtctgaccctcattgtacttatacagctgattgttcccatttggtctccaactgcaaaccgggtacaaataaggaatcagtgagtcaattgtatcagcatattctaaagattggataaagtatccgttaaatgccgtaagattttgaaaataatcaatatctgtatttaaagaattatagcttccttcttctgtgatcagaatcggccgtacattatcggtattctccatgtgtgctctcagcaaatccataactgcctgaaatctcccacataaaaaaccatctgagttttcttccctgccatttacatacaaactggccgaattctcgtaaaagtgatgcgaataccagtctaaatgccctttcgtatcatccataaattttaattgacgaaaagcatctttaaaatcatctttctcaatatacatgaatgcagagcttggtcctcccaccaaaacctcaggaacttccttcttaattgcatcagcaacttcattatgaaattcagcaagataattccacgctgtatcctcatcacatgtattgaaaaaagcccactcgccactaaatgtagattcatttttcacttcaatatatcgaggaccgtatccgtcaaatcttgtgtcaattgctttcgtaagctttgccgctgtatctgccgctgccttgaaatatttataatctggtgttgccatattaatatttttaatattaatatctcccagttctccccattgccactcgggccatccatcataagtcagaatataatcatcctgggttgccggaaacagagtgttcaatttatcaaccataaccgggtttaaggcataactttcaaacaaagcatcggtattagagtatccgtcagccccctcggtcagcaacccacctgcgtcttttatttggaatgttcctcttcctggtgtaaacttccagtctctgtatgttttagagaacacttcatcatctaatatcggagtattcatgttagaaaacacctgtaccggcccgctgtttacatgtacacgcttaaacacatcatcttccattttgttaacgccatcaatgcttagattctttgtagcgtcaaatgatacagtagcatcaatcacatctttatctgatccaattactccataagcagatgtgtcatattccataggtaaaccgttttcttcccacaagttaataaaatttaagcttcccgtccccaggaacttcagtttatatcccgtataattcacttctccattcactttatgctcggtgggattcattaaagatgactcatttgccgaggtctttccataagaggtccattgaggttcacctccaatagaaaattcacctttccatgcctgcccatagtttggtaacagatgttcctttccgtccggatcaacaatatacattttgcatgtgccgctgtctgcaatcgacccagtataacgcacatctccaaataaacgtaaaatccttgcaatctcttctgggatagggatctcacactctccatttacctgcaacggctcttccggaaagtaaaaattaattcttcttacacgattttcaccattaatactgcttttataagcaattggatcaatctccctgttagaaaattcagttttatacttctctataaccgtatcgaccgtatcaaacgatattttattttcaataatatcttctggtaaatcactttgtctgtcttctgcctgaacaggcttatttgatagcgctaatgtcggcagcatcacacttacacataataaaactgctattattcttctaatccttgtatgtttcatcttctgcttctgttctcctttcctcattacaaaggttttgtctgcgtcccggatcgttgacaatcgcttaggcatgttggatagatatttgccgcagccgcaattctccccttccctcctttgtacctgtcagcgaaatctttcgcaacagaccgctttcctgtggtatttgaaattcacaacaatagatttgttgatcctgccttacctccaaagggatcgtaatttctccaggcgcaagtttccaatattcacctgtttgatccacccactccagcttaagcagcagcatctccgaaaaaccgctccattccagttcaagacgcagtctcatcttccccctcattaatataccaggaaaaaccggactgcgaattccacgcatttctgttggaataacacggatgccgcttctgtcccaatgcacatccgtataatctgtcagaaaccagttattgtttcccagggtaaaatcccactgcttattcccacttgtgtcctcactgtcatcctgtggaatcacaacatctccattgcaatcaaactgcagctcctgcacacgaatcccgcggtaaaaaattcctgtatcatgaaattcattgcagatgtaccaatgccctttccattggaatacatcattatgaccgcctcctatgaactttcccttatacagataaggacctttcagatgtttagagacagcgtattggtttccataacacagataatactgttcacggtatttgaatactgttgatttatcacccgtcttcaattcccgtcccttagcatccagcacttgaaccggctgcgccgctcctgacggcgccaacagatcttctgccagttccacacaatagtaacgccccgcgccaaaaaacatcgtataaacaccatcttcttcatatacgctgggatcatatactgctgtatctgcaaatccctgcggcagcagaggttttcctaatacatccttatatggtccctcaacatgttctgcacaggctactcctatatcaatattcttattggagaaaaaccagtagtatttttcatctttttttaaaatataacccgcccagcaattatcattcaaatccccaatataagtatcaccaggtaaaatctctccaatctttttccaatctttcatattaaaagaggacagtatacaccatttatccattcgccaggtatcttctgtttttggacttttgtcactcccgcagaatatgtaaatctggtcattttccaccaatgcatgtgggtcggccaaccctgcaaaaggcataatatttctattgatcattgcatttttgtatgaaatttatagaagctaaacaacatacttttcctttcttttaattttctgattataatacattcagatactgtgtactttagatttcttttctgtagttcaactacttgaaggagttgatatttataggtttataccgtcattgtgcaggtttctgcgttgtacgattctccttccttttatactgccttaaaaatactgccccaagaacagacaatgccgccaaagttactgccagacctgcaacaggcaatgcagttttatcacccgtcttaggcaagccaaccggtttctcaccattcggctctttcagtttctcaccattcggctctttcggtttctcaccatttggctctttcggatcctctccatttggctctttgggcttatcctctccatctccttccgcagcaaaaccagtcactaccacttcgcagcgttcagccacatcaggatttatcaaagattgcgctgtgatgaatgctttcccatcccctctcgccgtcactgtaccgtcctgaccaactacagccactttttcatccgtactgctccaaacaacacccgaatcactaaccgcttccggttttacctgcgctgttagccgcccggtaggagactcttttgttaaaaccaatctgtttgccgataaaataatttcactcactgtcaccttcgtctttcctgcattaacatcatctatgacataagacgcagagacaatatcctcacccagcaaatcgctgttctcccacatatatatgcttatgttggttatcttttccgcattcagtccagcattagcgccgaaatatccttcctccgcgccccatacatcctcagattttccaaactcagctatctttagcgttcttgtatttttggacggtattacaaaataaaacgttctgatagaaccgccgttgtctgtcacattgacacgtatctgtatatcaaaggggttaatgttggttacattcagtgctaacggcataccatcatcaaaatcccaaccttctgcattatttgcctgaagcagactaaagttccatgcattagggtctttcaccagctcattgaccgtaactctaagcgcctgttttccctcagtaacaccttccccagtcacccgtgcaatatgcattggcctgccagcagtaattgtaaaaacatcctcttcgccttcttcaaatgaaacattagggaatttttttcgttctgattcctgaaaacctgatactgtcacagcgcagcttgccgcgagctgccggttatccttggatgtcacagtgataactgccgttccattcttatgcgccgtcacaagaccgtcctggctgactgccgctaccctttcattcgagctgctccataatacttcccgattacttgccgtctccggcagcacctccgccgaaagccgcaggtcacgttccgccggtgtgagggaagcctcgctctggcttattgatatactggcggcggctgtataagtaagccgaatatcataagcactttcattgactgccttggctgctgcgaccagttcggcatagggctgatctgtcatatctacaaagccacaattagaattttcaccatcccatgcccttcccaaaacaggctggtcatagtattggaaccagtgagcgcccacaagatattcattttggaatactcctgtcatatagttcgtgtaggcattcgcccttgcttcctgggtaccgacctgcactaaccccggtgcaaaatggctgcggtcgcaggcattgaaatgaaattcgccgataataactggcttatcgtaagtacccaactgcataaactcctgttctgcatctgttttataacagttaaaacttacaacatctgcatatttcgcacatgcctgaatcacctcgctgccgcagccccactgtgccagccgtgagcccaggtacagaatatccggtaatttctccttcacagccgcactgattacacgatagtatttatcagctaataaacttaggcacatagatgcgtcttcttctgcaattgctccgtcatatgatgactcaaccgactcccatgatgcaagctgcgtcccccatgcagtattcaattcgccaatatccgcatacttgtccttcagcgctgcaataaattccttttttgcataaatatcagcctggttcgcatccctcttaaatgcttctttgatcacagaaaatctttgagccggaacccctgaatttccccaggctatctcattgtcaacgtagattcccatacagtaaggatcagaattaactcctttatcagcaagtgcctgcatctgccccattgcttctgccgcaaacgccggatcgaacggatccgaaatatctccccatgaaccgccgctggataactttgcatggttttggttcacccatgcatgggcaacataagggaattcatattccgccccttttccatagaacatgtccggatctgcccagcagcccatagaagaaaacccccatgccttgaatctcctgacagcattctccttccaggcttcctcccatgtatccccatacttgcgttccagattcgcagtatagaaattgaatgccttgcccgcgttctgtccaaacggcggacgcaggcaatttgcaacatctgcatagtgttcgcctaattctccgtcctgcgccggaagcccctcgaacataaattccctcccgcttacccatgtctgggcatcagccaagcgaataatatccaggcctgtggatacataaggatacccttgaggatcaatcagcatccatttcccttccagcttttttgtgtaaaaatgcccggtagcctcttgtctgtaagcctcattcttcataccataataagcagagatttctctcgcctttgtctgctcaagctgctcgccaagcaatatctcctccgtatttttacttgtctggaagtcttcatcagaacgtattttattgctgtgatctatcccgttatactgcccataggtatccaccagattagaataggaagactgaagatcctgattagggtcgctgatcacggagatattatcaaaaataagcgttgtttccttcgcacagccattcagccagaaggtaatgtgtttgatcgccgaataatcaacaacaccggttccccatccgtaggcggctgacacgcctgcattgctcggaggattcgccagcatccccagctcagcccccgttgctgatgctgctgtatttacctttatcgtcttttccgctggtatagtcaccttaaagacagcatcctgaccgacatcattagccactgaacagtcaaactttacacaaagctccactgcattctgcattgtattcgtcacatcaaaacttagacagctatctgttccaaaatcccagaccttcccttcttccgcatataaatgaaatccaggccacaggctggcgccataggtcaccttcattgctctgtttccatctgtaattccttcattttcaatgacttctatttttaccggattagcctggtcgtttccattgctgtaattcgtgtatgtttccccttgctcaaaagaaatcttcggcagcggaatcttttcgtccccgctgcgatttgcctgcgccgttatgtctgtgttattatccacaacatctgcctgatccatatcttctgtcatggcctcgtcttcctttccttcactgcctatttctttttcctcattcgtatcagccatactcacactcgcataaggtacagacacggaaaacactatagcagcgatacaacatgtcatcaatttgcatataaatctcttcaccctcattcttacacctctttcactgatttttcgacgaaatggttaatcttttaatatacttgatatattacgcgacaaatttcccccctcttcttttagtattttattttcttgatttctcgtttttattgtatactattaatagtttttaatcaaccattattgtttttttataactttttgccagtttattatcagtctttttgtgcacaatagcctgaatcttaattgactttggcatcacagaactccataatgaaataccaatcaaaagcgggaaccgcataccgccagcccccgccttgatttccgtatcaaaagattccccgcatcctcttccggaactctctgggagatctcccgtcattttgttgaaaaaatctggaaaaatagaacgcgtcagagaatccgagtaaacctgccacttcctgaatctgcatatcagtcatgaggagatatttacgcgctctgtccagaagcagtatttccatatactttttcagtcccatgccagtatcccttttaaaattccgtgataatgtatagtaggaaacatggtgtgcggctgcaatatcttttaaggtaagctttgcggaaatatgcttttccaaatatgcaagcagctccttctgtttccaaaacccctggtaattctgcaaaccaccctgttttttactggcttcaccgaaaaaaatcgaagcatattgatagagtatgccttttatgcgtagtgcatcttcattcccgcctttatccagcgcctgcatgagcacttccaaatcacgtccatcgcacttctgccccatcacctcattacagccataaaaacagtccaaaccagaaacccactgtatctgcatatgaaagtacagcttcctgatatggcgtatctctctgtagtcataacaggttcctgccggtataaaatatacaaaaccttgtttcagccttacgctttgatattcattttgcacttcaccctccccttccagcataaaatacagcctgttgaagggggatatgatcttgcggtaattccaccctccatcggtttccagcaagccatgttccagaacgaccatattgatttcattaaagctattgtccattacttgatacttcctattattcatgcaattttctccatgttttaagcaactttccccatgtacatattcaccgtctgaattatacttaattatataaaaaactcttgaaattggaaaggataatttaatatgtcatacaaaaatggtataaacgcactgcatttggaaatgccggataaaattccgcgcaccgaatactccgcacatttctactgggatctgattcaaaaagtgacaggtattcaggtaaattcaaagagcagtactgtaacgcaaaaaaaagcttcgggagaattcataaaagcctgggattatggccttgtctggaatgtacttcctttcagtgaacaatttggcgaacttcgtacaagaatgggtcacgcaaacttcgctcaggacggcgctgatttttctgataacgtacatacatttatagaagagcctgaagacgtgtttgattttgactttttcgaagcctatggaaaccgccctccatccctgctcaccccgctttttaacgaaaactataaacagatgcaagatgcgtaccctgacacggtaaacatgacaggaatctatacaacctgcatgtccggcgtcattgaaattctcggatgggatatgctgcttttagccgccggcattgattctgatgaattcggcagcttcatgaaccgctatgcagaatggaacatgcagtattttaaggctttggcacactctgattctcctgtggttatggttcatgatgatattgtatggacacagggcgcttttctgcatcccgatttctacagagagtatattttcccaaactacaaaaagcttttcgcccccctacacgagagcggaaagatcatactttatacatcggatgggacttacagcgaatttatagatgacatcgcttcctgcggcatcaatggatttgtaatggagccaacaacagatatggaatacatctgtaagaaatatggccaaacccattcaattattgggaatgcagatactcgtattcttttgaagggatctaaggaagacatagaaagagaagtaaaacgctgtacagatttggggcgtaactgcccgggctacttcctcgcagtcggcaaccatattccttccaatacaccgttggacaattgtctgtggtacaatgatatgtatgaaaagtatagccggagatagcaactgtttttaagaagaaaacaagaaaatggaggaacataaattgcaagcagaacagatggaaaacagactggatattctaaagcaacacttaaaaaaaattgatgaagtaattgaaaatggcccctataaagctcattgggattcccttgcttttcataaagtacctgactggtacaagaatgcaaaattcggcatttttattcactggggcgtattttcagtacccgcctatggaagtgagtggtatccaagatggatgtataaagaaggaaccgatgagtacaggcaccataccagtacctatggtccactggaacaatttggttataaggatttcataccgatgtttaaggctgagaattttaatccagcagaatggattaacctgtttaaaaaagccggggctcaatttattatgccagttgcagagcatcacgatggttttcagatgtatgacagtgaactttcagaatggtgtgcctccaaaaagggcccctgtaaagatattttaggtttattaaaagcagaaacagaaaaaaataatatgacctttaccgcctccagtcaccgtatagaacattactggtttatgggaggaatgcgtcagataaaaagtgacctcccagccaatcttcattacggcgatttttactggccgtcctatgaggaaccattcggagatatggggcaggatgcagtacagggatttgatgtggaaccactgtacatggaagactggcttgccagaacctgtgaaattgtagataaataccgtccgaaaatcatgtatttcgactggtggatacaagtaaatgcaatgaaaccgtatctaaaaaaatttgcggcatattactacaatcgggctctggaatggggagaagaagttacaatcaactttaagaacgatgcctttatgttcgaatgtgcagtacgggatatagagaggggccagctggcagatatctctccctctttctggcagaatgatacttctgtagccaaaaattcctggtgctatacaataggcaacgattacaaagaacctcatgaggtcatatgcgatcttgtagatgttgtgagtaaaaatggttctttactattaaatataggtcccagagcagacggaacgattcctgataaggataaggaaatattaacagcagtaggcaggtggttggaaacaaacggtgagggaatttatggaagccattactggaagaagtacggggaaggacctacgcttacaaaggaaggacactataccgatatattaagagattctttcacctcagaagattttcgctttacttataaaaacgggtatatctatgctttcgcaatgaaatggcctgaggatggtatcgttaggatacacctgctgggcagaaaatcaaaaaccttcaatggagtcattaaaaatgtacagatattgggggcaaaagaagattgccggtatatgctttgtgatgagtatcttacggttatggcagagggtattcacacaaaagccccggtagggattaaaattacgatagattaatatgagtatataagtagtctacaatattatttaacaacgggtcaggcgtgttaaaccctgactcgttgttctaagagaacttttaaaacagtacctctaagcttcaataccaaatgacctgggagcattgtaaagagcttctatattttctaatggcacatcactttcaaatgcctgacttgccattaatatgtagccgccattacgatttagtgttttcataaaatatttcacttcttcctttacctcttctgctgtaccaaaaggaagaaggtattgcgtatctattcctccatggaaggcaatctttccgccaaactccgaatatagctcttccggctcaagaccctttactttctgtatcggctcgagtacatctactttacattttattaattctggaatcagctctcttaccgccccgcaggaatgctgctgataaaacacatcatattgatgtgcaagatctactagtttttttgtattctcttcaaagaattctctccacatgtcaacgctgaataataaggaaagctgggtaccataatcatcatgtgggcgcaatatgtctatcctgccttctgcagcttcaaaaattcttttataatactccaactcaaatgcaaccatcttatccagaatgtattttgccacctccggttcctctaacataagtacaaaaaattcttccatattcatcaggcaggttacctgctgaaatgggccctcatgccctgtaataattgctttatctggatatttgcaacactgctcttttatggacttataatcaaaccagtccggatccggaactataaatttttctgcatcagatttgctttcgatcccacttaaaggatagtatgagactaccggatatacatccgtttctgttttatgcattgttgtttcatacccccaatacgattcctttacctcctcgcctttggaattgatataacgcttcagttcaggaccgatatagcacggctcaaccgaaacgatatctatatggaatttatcaatcagctggctatactctgaaaatccatagcatttcataagcttttctgttacgcacgctactgctccatatgctgccggcaccctgtctggattctgatgccgaattgccgcccttactctttctcttgatgtcatcatagtcatctctcctctatgctctgttttgtacgcctgcgatattctgtaggtgtcatattctctgtctttttaaaaactttagaaaaatataattgatctgagaaccccaaagcctccgcgatttcttttaaagataattctgtctctttcagccatgtcttgcttttctcaattctgaccctctgtaaatattccatcggtgactgttgaaactgctgctggaatatggtcctgatatatgccggtacaaaaccaaactcatcagacagggtctgattcgacacatgcatactataatgcccttccaaataatttctcacctcataagcaaatttttctttattgccgcttattaccgattcctcgtaaaaagcatcgactatcagtttttttacctcctgatatagagcttccatggaatacacgctttctattatgctgttcacagactcttccagatagatgttattgtacctgcatggaaatttgccgctgtaaattaaaaaagctgcctttaacacgcgcaaaatatcataacgttttttcccccgtttctctatctcttccctcacagcctcatacatctgtgccggaaaatgaacagcttccagtaagctcatcttcatatccggttctatggcttcacattcttccaactcaaacaggccgctctcttccacgctcatagaaagcatggcgccgcgccgcatctccttctgcgccttgtagatctcgtgcatatacaggcttctgcggtacaaaataatggttaacacgattgtagtgtgggattccgactttagaaaccgtcttagaagctcgcctaaccgtccatttccctggcgcagcaggacaaactgctcctgtgcatttttcccaggaatcaaccagaattcctcttcatcaagctgggaatgtaaaaaccctctcaatctttcttccatacgctcctgtaaaacagaaattgtctgtgtgtattgctcaatggaaaatgctccaaaacagcacaaagcaaattcatattgtacagattcttttttgccgtccgtctctgcctccccatccagtcttttcggtgtatcacagcaatttcgttttataaaatattgttccgccttattaaggatctgccgcaattcttccatttttacaggcttaagcaaataatccatcgacccatggcgtaaggcttgctgtacatactcgaaatctttatagccgctgacaacaataaccggaatttctaactcctcctgcttcatgtgcctcatcacttccagcccatccattaccggcatccggatatccagaaaaatcagatcaaccggctgcgtccgtattacttccaatgcattcttcccattctgggccctgtagtatacctggaaagccggattgcatttttctatcagccggcagatatttcttaagataggcgcctcatcttctactaccaatactttcatatgctcaccttctccctgcttaattcgtatattttctgcctcagcttctcatgatccctgggcgtaacagacaggcttgtctgaactgttcccatcgggcagttacattttaatgccgccgccaagatagataaccgaaaacttatctttttcactgaccaccttaaaaatcatctcttccttatattctaaatagagccttgtcataatattgcggatgcttagtccgcctacctttaaattatgattgataatctccttgtcaccagacattaactcctttttaaatgcatttatctgctctatttcctcacttgtaaacccaataccgttatcatagaccttaacgaaccatttctcccttccccaaacacaggttatcctgatattccatggaaattcctttgtctgcaggccatgactgagggaattctctatcaccggctgcaggatgaaccgcggaacctttatagaaccctcaggtatataattctccagttcatactccaccccattttcgtaccgcatcttaacaagcctcatataattcccaacatgctctatctcatcctccaggtaaacagactggtctgtaaactcattgctgtatcgtatcatatctgacagatgttcacagatttcaattacggtccggtaattttcttctcctgcatatgcctgtatgatggacaaagtattgtgtataaagtggggattcatctgggcctgcagtgcgaacatatttgcctttacctccgcggttttaatcgccacattctgttccatagattcatgcaggctcttcatcatttcctgaaatgcatcagagataacctgaaattcatcgtcgtatttgggtactgaatccagcacttccttttccagctttgtatttcgggcggtttcacaaagtgcaagaagcggctgagtcagatgagaggaaatctttttctggagaacggccaggactattgccaatatgaccagtataagggtggcgtacagaacaaaaaaaacgattaactcccgctgttcctttttatttctaagcgcaagaatcccaataccatattcctcaactgtcacatcctgtatatagtattgttctctgtactgctcttctaccctctcttcatccagaagatcttcatctgtaagcccattcataaccgttttcggaatctggtgaaaaaacagcggggtttttgtgccggtattatatacaatatatccatccgtactggtgtcatccccgaaaagctgcttttcccacagcccaagagcaagctccgcctcaatatagccgacagtctccatgccgaaaattgggcttgtttttattttacggaccacagaaatacgatctgcatcaaggcaaaaccagtctgccgcttcctgcttttgcttaaacacctcggggatatagctatgttcacggtacgacacactttcctgttcatcaaccgcttcacctacataaacaaaggtgccttcatcattataagcactgatcctgctgaccttttcacgttccaggatatacggccacaggatcttatagacctctgttttagcttctgtgtctatgtcaaataaatccgggctttgccgtgctgcatttaatttacccgcaagaaaatcatttgtcccggtctgcaggcttactgtttttaacagttctatctggttcaaaatattgcgttctatccccctcagctcattctgcatatcggctgtggactcacgttctttagcatgaacatatacaacaatactgaacgaaaaaataacaaataaaactgcgaatagaagagctgtattaattgcccatagttttacgctgaagttctttctcatatccggcctccctggattttccgtctccgcaccccacagcctgtttaaaacttacatgtaagtctccgggagcacaaataataacacttacgattctttcagccaatatctccgtcccataggatgtgcttcgtccccccactcatccttatactctgacagaatctgctccagtctgagtcttgtaaggcggcatgcttcttcctctgcaagattctctgtttcatcgggattattttgcaggtcaaacagctgtgtacagtttgatacgttccgatactggatcagtttatagcgtctgtctttcacaccgcgtatcagatcattataggcaaagtacaaagtttcccgcgttactgatgtctcctcaccaaaaaccttctcaaagcttttcccttgtactgtggggggtatgcttatccccaatatatcacagagagtgggatagatatccaaaagatacacaaattgatctcttacttgccctttgggaatccccggccctgcaaagataagcggtatacggatgctttcttcataaagattctgctttcccatcagtccgtggctgccgattgccagtccattatcgcctgtcagaatgattattgtattctcccactgctgatttctttttaaagcctccataatttttcctatttcatcgtccagatgagtaatcatcgcataatactccgcaagctggcggcgcatctcttcctctgttctcggataaggtgccagcagctcatcccggattccggaaaccccaaattcaaaatgctgcttctgaaaattgacaggcagtgtcatgttttccggttggtataattccttatatttatcaggcatcgtccgggggtcatggggcgcaagatacgcagtatacaggaaaaacggcctgtcttctgtatactcgtccaaaaatgagactgccatatccgtcagcagttccgttgaatggattccgggatggaatctgtcacaatgctgtctgattactttattttcttcccaaaaattagcgacaaaattaatttcattatcatatttacccgttgggtcataataacacgtaggcacattccagtgatcccacatgccgccaaaaaatatgttatctccctggtggaaactccgggtaaaagagggcgggccattatgccactttcccgtcccatagcaataatatcccgcctcttttaaagtttctcccaatgtcttatgttccacaggtatgttctgcccttcatcctccagttgaaacagcgtccgcccggtatgtatcattgccctgcttggcatacataccgctccgctggttccccccggaatatgggcctgcgtaaatgaagtcccgcatctggcaagtgcatccatattaggtgttataatctccggatttcctaatttcctgatggtgttatacctttgatcgtctgtaacaataaacaaaatattaggtttcttcgaatgtttcatataatcttttcagctccttataatcataatcttcatccctgtatttttctttcgctttttccatctgccgcttcaatttttcctggatttccagatatgcgggctgcccatatatattgttcagttcctgtggatcccggatcagatcatacatttcaaatccgggctgcgtaggctgtttcaaagcccccttcgcatccagaggcataccataataaaacgtcagcttatattcttttgttctaatgccgtaatgggcaggattatcgtgattgtgtgccaaatgcatccaatatcggaagtatatattttcatgatattcttcctgtttctttcctgcaatcatattccggcatgagattccctgcatgtcttttactatatcacatcctgcataatccagcaatgtaggtgcaacatctatgttggacatcagttcaccgcagacggtgcccggcggaatttcttttggatagcggaccagcattggtgtccgcaggctttcttcaaagctccaccttttatcctgataatcatgttctcccaaaaagataccttgatccgatgtataaatcacaattgtgtcatctaagattccctgttcttccaactcatttaaaatatttcccactgactcgtcaatggccgccacagtccgcagataatcctttaagtatttctggtacgcggcatatcctttttcttcgaaagacattgtttctgttttggtcagcggccctgtgacataatccggtctgcagaagtcttcatacaggctgcgtattttacttctgggagtcactgagctcccccgctctcttgtagcgggacttctgtgtgccttattctcaaataagctgcacggtaccggtatctctttctctgcaaacatgtcttcatgtctttcatggtattcccaaaaatcatgcggtgctttatggttgcacatcacaaagaacggtttcgaccgttcccgctctttcagccaccgcgtcgtcatatctgtgataatatccgtcacatatccttcatgctgtctgattcccttttgccgctctttaaaaaatggattaaaatataccccctgttcacctgctttccctgtcccatccgataaatacttatattcatcaaatcccaaaggctcacatcccagatgccattttccaaataaagccgtagtatatcccccatcctgtaaaagttttgccagattaggccctttctctggattccagtcatcgtccagcgtcctcactccatttatctgcccatactgtccggtcataatggttgcccttgccggtgtacaaactgcatttgtagcacagtatgcgtccatgcggcatccttcctttgcaagccggtccagatgttttgtgtgaaatacaccagataaaatggactggtaacagcttatggcatttaagctatggtcatccgacatgatatataatatatttggttttttcattatgtcatcctttcacggcaccagacgtcatgcctgatacaatatatttctgcaggaataaaaacaaaataataattggcaggactgtaagtgtcaaaactgcaaagacgtaattccaatttcttgcaaacataccaaaaaaattataaactgacagtgttactgtccatttctgcgccgatcccaaatagaacagcggaaccataaaatcattccaacagctgattgccgtaatcacaatattggttaccgtaatcggttttaatatcggaagcagaacccggacaatcatcgtaaacggcctgcagccatcaatcatggcagcctcatcaatctcacggggaatccctttaacaaagctgctgaaactcataatggtaaatggcatcctcatgcctatatagattgcaattacagcaaatcttgttccgtaaatattcagaacttttaacaatgcaaatgtactggcggtctgtaatgtcatggtaagcccaaaaataaagtagtaatataatcttttcgatgttttatcactcctccggcttattactatcccggcaaatgcgccgaacagtatggtaagtaccgtagcactgactgtaataacaaaactgttcatatagcctctgagtatattaccatgctcaaaaacatacgaatagttttcaaaatgaaatgactttggccaggaaaggtcgaactgaagtgcctggccggcatcctttacagagcctaataacatcatgataacgggaaccagaaacatggcagcgaggataatcatgaaaatatatttaataacggttcctgcttttatccttttcatcacatttctacctcccttttcgcaagatatcggttcagcagaaacgatatgcatacaacgatcaatgataatatgacacttgcagcactggattctcccagcagccccagaccaaatgccttgtaaacaaatgtgctgagcacctgcgtgtcaaatcccgggccgcctttggtcagcacgtatatcaaatcaaatacttttaagcttccggtaatatttaaagtgataataatggtaaaggaaggtatcagcagcggaagcgtaatatgcctgaactgcttccattttgaagcaccctcaatacatgcgctttcataatagtctgccgggatagcctgcaggccggcgataaagataaacatattaaaccccgaccacatccagccttcaatcaggatcacagaccccatagccgttatatagtctgccagccagtttaccgccaggccggacagccctatgcctgacagcatgtgatttaaaagaccgtcatttgccagaattgacgtaaagataacacctataatcattggacttaacacacaggggacatagtaaattgtccggagtacattattcaattttgatgcctttactaatgccagtgccagcagaagaccaaacaatgtctttaaaattgtagtgctgacagcaaacagcagagtattttgtatggatctgataaagacgggatcctgaaaaatctttatgtagttgcccagccccctgaatactggattgtacattctttcaatattccagtccgtcatggacagcaccgtgctgatcacaaatggaagtataataaacaatgtgtatacaagcagtgccggtgtcgcaaaataaattggatatcgttttttgtttaatttcttgtgcataataaaacctcctttcaaaaaaggtacggcacatctgtaccgtacctatttgtttttattcgaatcccggtgcctgcttctctttcatgtatgcatttacatccttctggaattgagtcagaagttcttcccctgtcattccttttgccggtgcatccagatagtaaacccataatgttgttttatataatggctgtatatcattcagataattattcatctctcccacgatcttcccttcagaagaatacttttcataaagacttaaaacctcttcattcatcgggcctccgtcagccccttcaaaggccgggaaaccggcattgtcttcaaaccacaggtttaaatattcaggcgttgcccataaatcaaaaatcttcttcaccgtatcaagatttgggctgttttttgaagcggaaaagccgatagagaataatccgctgaccagtaaatcattcttgttataatcaaacggtacattaaacatcccgattggcgcatccggaaacgtcccttctatagagctcaggatgcctgctgagccaaacagcattgcgccttccccatttgcaatacgttccagattggcatcatggcttaccgtcagatagtcttcattgaagtatcctttctcaaacatcgaaagatacgtatcaactgcctccaccatttccggataatctgtaaactctttctcatgtgtcagtatactgtctgcaatggctttggcactatccacgctcccggcagcaagcccctgccctgtagacatccatatctgtggtacccagttatccgccggcagtaataatggagtaattcccttttctaataatgcatcgcacacagcatcgaattccgcctcattggccggtatctccagattgttctcctcgaatacctgtttgttgtacaaaattccagataccccggaactttcctgaaatgggaagccatatattttcccgtctttatgtgttactacatccggattcttcagattaccaacccactcctcatccgataaatctgccagatatgtctccggatcaatcaggccatagattgccggcagattataatcaatcatatccggtgcctctcctgaattgattttcatctgcagaagattattatattggtcatccgggacgatctgaagatccaccgttatattttcttcttctttcaatttctcaaccattttttgcagacccggataatttctggactgctgcagcaatgcagaaacagtcacttcttccttcttttggctcttttcgttcttttcatccgccccctcttttgcagtaccgcatgcggccatgcttcctgccagacagactgtacacagaacagccagacacttttttaccacttcttttttcatttcctttcctcctcgttcatttgatacgtttagttaaccatattttcccctttgattctatggaaaattaattacatatttatgtaaaatcagaaacttcaaggagtgtcatctactttctcaacctccacataataagctccaaaggatttatgactgtcatccagaaaacccgcttctaaaaccgtatcctgtgcagcattcacctccagctcaaaactgatttcctgactgtccagctttaccgccttatattgcttcatatgatccagcttaatccatgcatcagtatacttcacgtgacacattggatagtcgggcttatatggcgccagtctgtcaatatccccgtattcctcattaaggggtaattgcagttctgccggccagcgtctgagtttaaagatatattttccagcaccgctgaatcttacaggccaccggccacagctctttgctgcttttgcaaccatatcctggctccacgccacatcccctaggacatccattgcattcaatgtggttggattttccttcgggtgtcccagtatgattgggcaataatcctccagagattctttcacatccccccaccagtcttcgtgggctttgcgcaattcccgtgtaatttccggatattctcctgaaacttcctgtgtctgctgggtatccttttcaatattgtaaagttccttccctcgcaccagtctccatgggcctttcagcacagtattttcccacttttccgggatgaatgtgtcctgacggtactggatgaattctattctttctttatttacctctattcctgagaaagcccgggcgaagcttgtgccatccattttacagtcctcagacatatccagcccacacagactgatcagagtcggcataatatccgtatacatgcacaggctgttacaatctcttcccccgctgatccccagtccaggacagcgtataaaaaacggcactctatgaccgccttcgtaatacgagcccttcttcccccgcatccctgcattgaacccttttaccacaaactcccgttcatcaactacggcgccgcccgatgttccattatccgtcataaatattaagatggtatcctcttccagattttcttctctcaggaagtctcttaatctgccaaagttttcgtctatacaggttatcattccataaaattccgggtaacatatgtcttctatgttctgatactgcctgctgtatctttcctcaaccagatatgggctatgcggggcattcgttgcaatacaggtaaaaaaaggctgcccttctctttctttcataaaccgcattgcctgttcaaaccagatgtcagtgcagtacccttcatacttccgcggaactgaattatcaaaatatgtatcatcaaaataatgatttccccagaaatccggcgtctgtcccacgcctcctcctttatgcgcgacaacctttgtaaaccctctgtcctgaggtctgtagggataattatcccctaaatgccattttccgaacaagcctgttatatagccgttatcctgaaagcattccgcaagcgtgtactcttcctgcttaagcagcgaccttccccaacaggttgcccataccccattgcgcaaggggcgccttcctgtcatgatgccaccgcgggtaggtgcgcacataggcgcaacatgaaaatcggtgaagcggacactatcctgataaaactggtcaatattgggggtatggatccggctgtttcctgtacatcccaaatcgccgtatccctgatcatcggtaatcactaatattacatttggatgttttatcaaacctctcataattcatgctcctttttaacgaaagatgttattttgccgacatgctattattgtacttcctgaggaatgatatgaacatggctaaatggatgcttttatatggaaaaatagaaataaacctatccactactatcttgatcaaacggctctttcaacatttggatatcttttttcaatttttctgacttaacctgtaatcctgttacggttagttggctaaaatgctgattttcagttactgtgcacgcccaaaggtgtgaaagtataatcgaacctaatttatacatttcttgacattttaatgggacaattttatactttaaattatccatgattacataatgaagtgaattaaaaatatggcgtttcacaaatccccttgcgtgaggctttaagaatactatctgcgaaggggttattcattactaagcatggggaagtttcctttattaattatagtatccattactttcacataaaaaaacacaaagaaaaacatagaacaggagtacatacaatgcccacaatcagtgttttaatgaaaccatcttccagcatgtgcaatatgtcatgtgattattgcttttactgcgatgaagctcaaaaacgtaatcaggagtcttatggattcatgagtgagtatactcttaagaatatcatacgcaaaaccatgctccgggctgaagggatgatcagctatgcgtaccagggaggggagccaactctgagagggttggaattttttgaaaaagctgttgcctatcagaaacagtataacaggaatcagattcaagtaacaaatgccctgcagactaatggatattcaattactgaagactggtgcagtttttttaaagataacaacttcctgatcggtctgtccgtggacggcacaccagacatacacgatactttccgacacgataaaaaggggggagctacctatgccagagttaatcatgctgccgagttaatggacaggtatggtgttgattacaatattcttacggtcgtaaccccgcttgttgccggcaatattacagatatctatactgcctacaggaagcgcggctggaattaccagcagtatattccctgtctggaccccttatatgaagggcatgggaataccccctatgccctgacccctgaagtatatggtcagttcctaattgatctgttcttcctctggtatcgtgacctgaagcatcaaaaacagccatatatccggcaatttgagaattatatcagcctggctgccggatacatggcagaatcctgcgaccagcgcggcgtatgtggtattcagaatgtagccgaggcggacggaagcatctatccctgtgatttctacatgctggatgaatatcgtcttgggaattttaatgaagaccggctggatcagattaatgagcgccgtaaagaaatcaggtttatcgagcgttctcggatggttgatgaaacatgtcatgaatgccgcttttaccggctctgccggggaggctgccagcgcagcagagattataatccggctgacggaacctataaaagctatttttgtaagagttttcagatgttttttgaaaaatattatgacacaatcatgaacattgggaaacagataacttcacgaatgtgacaagtccgaaattgggaaagggacggtaagtttatatttgtccagtgatgtgttcgaaaaatcttcacgttccatcaccgattatcctgatgatatctgcctgtagcaggatatcactttacaatggtgtataatctctatttttccagagcatcatttctatatataaacaacttgattaagtgactacctaccacaaatcccccctgagtctgcgaatagattttttagggggattttttattttgaatgcatggaaggggaagtcagttaaagcaatccattgtattttggtaagggataccgccctatcaaagacctcccttgtgccgctccccatctctcgcaaaagaaaacgctgctgcctgaattgcaccaaggttaacttctggccctgctgaaagccttctttgggtgaagcgataatactcaggcgatcttccatatattcctcagtgtacatagcagggttgtgtgaagtgccctctatcaacgtaaagtccagtttgttattcataagagcttgctccagttggtgggatggggcaatcgtaacatttacctcaatgcctgggtgcctgtgataaaacgcttttacatagctgggcaaaaactgcgcacctatggtaatgcttgcccctattcgcaaaagaccgatggaatcccaattccgcatttctctctccatatcttcaaactgagcagagatacgaagtgcatattggagaaaattttctcctgccggaatgatttgaagccgccttccaattcggtcaaaaagaacaatgccataatacttctccaattccttgatggcgaggctaaccgctggctggatcatattcaagttctctgctgctctagttgtattgtagttcacatcacaaatggcgcaaagtcatttttgcactcctccttatatcaaaaaccgtattattctgatttaattatattatttccattatcagaaaacaagtgcgacataatacccaaggagggtgataacatgaaaaattaaaaaaatctgagttagtaaaactgtttttctctgtgttcaaactgagcgcctgcacctttggcggagggtatgtagctatgcctttgatccagcatcaggtagtagaaatgaattcctggttcaccatgacccaatttgcagatattgttaccatagcggaaatgacaccgggtcctattgcaatcaattccgcaacgtttgtaggcacgatggtagccggtctgcccggtgctgcccttgcaaccattggctgtgtatttccgtcttgtgtcattgtgttgacactggcatatgtttactatcgtttccgaggattaagtattatacagggcgttctcgccggacttcgtcctgctgtgattgccatgatcgcctcggcgagaatcaatttgtttttcacagcggtttatggcactacaactttgccttctgatcttgccagtatagatattccggctttggtaatcttcctcggtgcattatttgtactgcgaaggtggaaggttaatcctattaaggtaatgtccggggcaggagtatttggtttaatcttgttttccctactctaattcggaggtgaaattatgcggtatatgatgaaatcaggaacactatccatccctgaaaccggaaaaatgcttgcccaaatcaagagttctttttggggagcaacgaaaaccattttcctgtcagatgatgataaacagtatcatacagatattaacatattaggtgctccaccccaaaaaagcggggatgttcgtttgagaatttttactttaaataacagtaacggcgaagtgctgatggaagctcacccctgctacgctaaagacgatgatcctgacattgttggctggccgatctgtcgttcgccgaagatcgatcatgcagatttatccatcggagatatcgggtatctgctggtcaggcacaacatccagaactattccctgaaagataagaatgacactactatactgcaaatcatgcacaagggaatctctggcggatggacgattgatactactgaaaagtttccagcacaagtgctatgtggtctgtttatattctgtcgttacatagagcaggaaaacgaatttatagttgtttgagggaggacggattaggcatagccacgatacgcgcttctccccctcctttgtccaaagcttcagccgcagctattacattgtatgctaatgtgccagtgacaatgagcgttacgtcatctccttcacgtataacattacctttacctacgacaaactgctgtattctttcgaggtccagcagttatttttttacgaaattaccgatcgtctgtctttcctactgatcaaaaaagagccgcacgtgctgctgtctgtccctccggcacattttcattcgaaaaaactgtaccaacttctccgagtgagccttcagggctctctcctataaaatgtgcgatctcacttactgttcgccatcccacatcaaaattaacatctgacggccaccttgctacaaacagatgggtatttccttcctcatcatctaccgctgaaatacaccagtaatgataacgctcgtctgaaattgcgggatttatatgctctaatgcacccgccaaatcactaacccccatttttaatttttttccctctaatgaagccaatccctctgctacatttttctttgacgtaaatccaactttaaatatattgtccgtttcacactccactccatctgagtttactgcatatacccaaatttatgaactttatctataaatcaaccgcataataagaggagtctgcaattggactttctgttaataatacgccctcatcgtaaatatgatatcctatagcggcttcagtcatattccacgttaactctacggacgtatctgcagcaatggtgtaaaatgctatgaaaagggatcttttatagaattctcattacccacagtgaaatcccatatcgaccagtctgtgattgaaggcattggatacatgatgaatctgcctgtcctgaggcggctatacttgcaggaacaggaatgggcgtatatgatcatattaagaaagccgccaaaaaacggtacgctatatgagtgtttatcagcctgatccggtttcgacggcacaatataaagaagcctacgaaaaatggctgatcgcttgccaggctagtagacaaaaacagatggcaaaagtgattcacctcactcatgccatctgttctttgttcgacgcctattttgcaggacgtattttaaagatatttcccgcccatgtttcaaaaacataacgatttttttcgtccctataaaattcgacagtttttccgtctttccatatttccagaggagtttcacatcgaatcacagccgtccccctgcaatttgcatacagaataccttccttcagtttcctgttttcccaggaaatatccacagaaaatccgccttccgcacataatcccgttaccataccgcattcccagcaagatggaagcgccggaagcaggtaaatctcatccaaatgactctgcagcagcatctgtgcgattccacaggctcctcccaaatttccgtctatctgaaatacccatgggatttcaggaaaattttccagcggcggatgcagatcaaacatgttgggagcagtcaactttcccaaaagatactgaatgtactggaccgcatgatcgccgtcctttaaacgggcatacagattgatcagccacgcgcagctccatccagtatggcctcctccatacttcattctgcgttccaatgagtttttcgcagcttccagcagttctttattatcatactcattgatctggtttgacgggaaaaccggatataaatgagagaaatgcctgtgccccggttcccattcatcataatcttctctccactccatcaactggccatgctttccaactttaaatccgggcagtttttctaatatacgggaagcctgatcactcagtactgaattttttccaagagccttttcactatccagaaactgcgtcagaacatctctaagaatcgcattgtccatagtggagctcatacatgatcttccaatttgtccatttttcataatatacgtattctctggtgaaatagagggacagatcaccaattccccctggtcctctatgagaaaatccacaaaaaattgtacgcattcatacaaaacaggatacatccgctctaagaactcagcatccattgtgtagcggtagtgtttccatatatgcgttgcaagccatgcaccgcccataacccagtatgttgctgtcacagccaaatcctgaggcgccgtgtccgcccatacgtctgtattgtgatgtgccacaaaaccgcggcagctatacatctcagaagcagtacgagttccgttctccaacatcctttccagatggtcaaacaaaggcatatggcattctgaaagattgcatatctctgccggccaatagttcatctgtgtattgatattgatggtatactttgaatcccatgtcggctccagcttttcacaccatattccctgaagatttgccggaagtcctcccggctgactgcacgacatcaacaggtatcttccatatgcatagtacaattctatcattcccggatctgcttttccttctgtaagccgcttcaatctttcattcacaggaagcttttccaacgccggatcttttttatctagtattaagacggaacgtccaaaaatctctttatgcctgcggatatgacgctcttctattccgctgaactcttcccatgtcaaattcttcatctgactttgcagatacgcagaacagtcctctattttttgctcccggagcggatacgtcgtgaccccgttcagataaaacacgacctgatccgcattttttataaccagatgttctccaactgtctggacagaacctccctgtgcacacgcttttgcctgtatacaaaactcgcttccgccttttcccagatctccgtcgatataaatcgtgttttctccaatacttcccgaacagttataataccgtcctctcgtcaacagagcagacatcgaaagggctgccggcttatccgctgaaaactctactgccagaacatccgtttccatggaaataaaggctcgcatcctatatacagtatgattctgtgtatactggacggaagcgatccctgtctcaagatccaattcgcgtctgtaatctgtaatcccgccctcctcatgatggatgtgataagagaattctcccaatgtctggtatggtctctgactctgcggcgttcccgacaaggcatataccatcagttcctccgcttcctcaatctgtccttttttcatgagttcacgaatttccgcaaagaagcggccagtatccggattgatacgattgacagggcctccatacacgacgctttcttcgttcatttggattttcccctcaaacggctctccataagccatcgcacccaggcgtccgtttccaagaggaagagcttcgatccatccccttgcacattcgttataaaatagtttactcattgattttccctttcccgtatctatccttcaaaggttcctttcacatctttccagtgttcctctgcatatgacaacagcttctccgcatccttcatcggcatcggatcgaagtaaagaagtatactgtgagaaccgtatttctgtaccaagcgatccacattcctgatccagtcgtctacctctccagtatagactttgatccataaagacttccccgcacgtcttgctttatcataaatttcatcccattcttccagtgttccgtccgggccgtaatctccgctggtccactgtagcgcatcgatctcttctatttccatcaatgcgtccaaatgttttatcgcatccggcccatctaaatgatacaggacattatccagcttcccggcctgttccctgagagaattcacgataaattccttaaactgtaccggggacatcagcgccgaaaaatcacactgcagttttgctgtctttccttctccccagatttgaaatacggtatagcaggatgaatcatcccgtctgtctttcaccagattataaaactgatcgtagtatttaaaatatacgtccgtaacctggtgaatcctttcttccacctcttccggctcatcaatcaaatcatacaccattttctgtgctcctcttaaagataccagaacatcaatattttccatgagatccggaactgcaacaaaaaagtcctctcctgcaagtctatggcattcttttaccagttcaatatgatttttcaaccattgattttcactgtcatatgttagcggcggagtatcctcccaatcttccacacattctgtaaaccagatggtatcatcgcggaattcgatatcagaccccaaatacgctgctacggatcccggcccaaaatctgcactcatatttggaaagctttctgccaggaattcatgattttcacaaaaattacggtatcttgccaccatccgttccgcattcatatacttatcgtccatatccaccggctctaattcggccggcagaggttctgcatcttgtttttctgccactacaatcattaatggcctgcctgtattcttatgcttccagtaatttcgaaatttttcctgtgtttcttcccagttcttcttatatttcataacaatctccattacgtttatctcttaatcttccaatcagttccacttcgtactttaattccttcatgcccggataacttcccatgcgctctttacataccacggttttatctgcatcatgataacaaaattccgtcactgcatattcccctttttcatagccgtagccatctccgcagtcttcataatatgtgaaactgccgtcttttcctgtataaaccaggagctttaatggacagccctccgctgcatttgcatattgaatctgttcgatcatgggaaggattgttcccgcttttacaaagacaggaatgcggtcaatgggtgcgtcagccgtgatccactgtccgccctcatagtatcggctgttccaaaaatcataccagccgcagcctcttggaagatagcacttctttactttatcccgctgaattttttcgctatttttttcaaaatacatcggctccgtcaccggatagaccagaagactttttccaaacataaaaccgtcccccaccgtgcaggcctctttatctttcgcaaaatcaaacacaaggctccgcatcattgtcccgtcattgaaggaaacatccgcagccatggaatagatatacggcatcaggcgatatcttagtcttataaactttgctattgcatcataaaacatacttccgggttctccgaagttccagatctccctcggcgtatctgtaccgtgagatctgaaaataggcagaaatactcccaactgcagccatctggtatacaactcctgatatccctgatcctccaccccctcttcataatctccctgccagaaccagagcatattgggattcccgttgctgccacagcctctgtgcttccagtttttatgtaccgtaaagaaagctccgatgtcaagcgtccagtatgggtatccgctcattcccatctgcagtccttccgctatttgcttcttcatggtatcccaagaggctgcaatatccccagaccagagaattgcaccatacttttgagaaccggtatatcctgatcttgtcagattgacaacacgtttcttttccgttgtttttctctggttttcatagattccttttgcatgcatcagtgcatacagattactctgctccggatgtagaaaggatttgtgttctgatgaaacaatctcgtaccgctcccagggctctcttttcatttctccattccagtccgggccggaaaaaggttctgttgaatcgcaccaccacgcatcaaaccctttggaaaacaaaccttcatttgcctgtttccagtacaatgctcttgcatcttcatcaaatgcattataagttgaacagtcattcagaagataccccttctctaaaaactgctggtaatcctgtgttccctctgcggccgtcggccatacagaaatcattgcatgtgcgccaagatcatgaatcttctccaacttctcttctgcatccccgaaacgttccggatccagaattttttcgccccagtgctcaggtttccagctttgccaatcctgtacgacacagtccaacggaatttctcttcttcggtattcttttacaatatctaaaagctcttcggcagaatgatacatttctttggactgaatatatcccagagcccaccttggcagcataaccgcctttcctgtcagtttacggtatttccgtataatctcatccaaagaattccctgcaataaaatatgtatccagctgctgcaccgtatccaaaaacaaataagacctgtcctttcctccatgccaggtcattaccgaaccacagtctatcaacataccatatccttccgtcgacagaaaaaacggcatcggaatcctcatattatgctggtataaatactgatccgcataacgataattgtaaatgccttcttctgcctgaccaaatccataaatgcattcctccggttttaggttcaaatgtagcttggctttgcttgactcgcccgcttctactgcctgcagattttttataaaattccgttccccgtcaatggttttcacacgctcaataatcggtttttcaccgactgttgtatattgaaccaccttcttcatctcggcctctctgcctgcttcctgcaaaagcctccggccatctttcgaataataggaaatgtgaccgttttttctatccactttcacatctaaagaacttgtagaaaccatccagcctttctgtgtttccttcacctcaaaattcccctgattttttgtacatttctgaacaagctgaccatcctcccgaatatgtttcataaccgtataaacacagcgtatgacatcgtcacataccgcttcaatagaatacattccctgttcatcctgcagttccagttttatctctgtttgtcttatttttttgatcattcttctcctcctatcgcctcagtttttatgatcttaccacttctgttctaatgatttctttctaacagcggaactgaaattttatcattaaaaaatgagattaatggccccatacacaatgctgtaattatcgttccaagcccaacctgtgctccgcatatccagcctatgatactgctgaacacatcacttccaagacggcagtatttgaattgccgccttaatttttctgaaagaatcagtgcaatagcatcatatgtagatactcccagatcagctgtaaaatataaggatgatcccaaacacataatcacaacagccatcatcagaaaaatacttctttgaaaaatatccggggtcgggaaaatgtttcgccacaaataagaagaaaattctacaatatatcctactgtaaatacattaagaattgttccaagccctatcttctttctgtcacagatacagatcataataaacaatacaaaattcagcagcatataaaatgtgccaaattttattcccgtcatataccataagccatgcgtaaatacctgaaacggatccattccaaaagtagaaaaatcaaacattcctacgctgatgccggcaagaaaaactcccacaacagtcataaccgaacgcctgaataatctctggaaagaagttcttttacaatttttcatttttaattttaacctttaatccttattccagggactcctttacaagaatctttattgctgaatatagatacctttctttaaccaaacgattatataacaaataatccagcaatatccttaatgcactttccccctgctgcatgatctcgctgtctatcgtggctgtaacaattccttttttcaaaagctgtacaatttccgggtaattttcaaagcatatcactttgatattcttacatccattttttttcagcaatctgccaattgtcggaaccccgccacatgtaataaaaattcccgacagatcatcctctttttctaaaatctttttcatttctttctggataacctctgagctttcctttgtaataatatttttttctatatttatttccggataatacttctcaaggacctctctgaaccccttttctcttgtcccgaaagaacttgaataataatcatcaaccgcgccagtaaaaattgcaacattcccttttccctgcagaatctcccccatcagccgccctgcgaccttacctgccttaaatccatcctgtcccacaaagcatatgtgctggctgtctttaacatttgtattgaccgttacaaccgggatacccgctttctgacaattatctatacattccgcaatttcttctgcattgatcggatttagaataattccatccactttttcattcaagcactgcatcaatacctttttttgatgctccacttccgaatatgctgtggttttatgggtaatctcaatttgaaaagaactgtaattcctgagctctttttcaattccctcttgaataaactccagagcatctacctttaaaagtatcgcgcatatccggatttggcgttcccgcattttcaatgcttttccgattggatccacttcataaccactgctttcaataatttcccgaacttttttgcgaacagcatcactgacccctggtcggttatgaagcactttatctaccgttgatctatgtacattcgccatttctgcaatctgtttaattgtaattttcataataacgacgctcctccatctgataataaaattattctgacaaatcacgtttattgtactataaatcttatacgatttaaagttttccctgactttcccgctctttcaggtcactcataatttgaggatactctttatccagattgtaaaaataataaacaatcaaaataataacacagcataccggcatacagaagtagtacacattttttatcatttccatggatgcagccgactgtactgcctgcattccgtcaaaacctgctgaatcatacagaaaagatacggctgctgttccaataccggaggcaatcttctgtccaaaggaggaggctgcaaaaacgactccctctgttcgtatatgtgaactccactgtacatgttctaccacatcagaaagcatcgcataggtcagtgcctgcaaaggagctactccaattccacgtattgcaccagccaccatcagtactgaaacattggtaggaaagattagtactaatccttgtgccaatattgcaaatataatacctgttagccctaactgccggcgcgaaaattttttcagcagcaggggaatacaaaacactcccaacatcatcattacattctcagatgtatttaatattcccacaactttcacatcaccaattatatactgagaataataggttgccgccatagaattggtagtctgtgccaacgcaagaaacgtccaaacgatcagaatcatccaccaatacttatttgtaaccaccgccttcatttcggttctaaacggaacctgttttttggttttctctccactttgttctggcagtatatcccctggatcaacctcaggacatccccagaaatttataaaaatacaaacactgtttaatataccataaatagcaatcataacgatccaagccgtctgtgtgtttccaaatttgtccattaaaggaagtgaaatcccatttaaaacaatctgaccaataaagcaaaatacctgacgtgtaacacttaaagttgttcgtccctcctgttgtcttgtcagaacagcattcatagaattgtatgtaattccgtacattgtgtatacgaccgtgcttgccagattgtatgtcacaaaaatataaatgctctttatcgccatacttgcatctggaacagtaactagtaaaatcaggctgattggaaccggaatcagcattcttaacagccagggtctacatttcccccatttcgttctggttctgcttaagaacgcaccaaaaataagatctgaagttccatcaaaaaatttcgagatgaatataaccatacctacaattttcatatctatgcctactacattggtataaaaatatgtaagtaaaaaacagatgatcacaaagggaaagtcgacaccgattccaccaattccataacataaaatcgattttttgcttaacttatcttctttcataaaataacttgacttgttactattttttatcattttccttttccttcctcatttcacttttacgagctcgtgctctttatatttcatcacatattttacagatttacaagccgtaaatttacataatttttccatgtgttttttgtgactattgcacatattatgaatataccgttcttttctgctgcactgttaaatgtaaaaaagacaaaaaaaattttatttttccactttaacgtattccctgattaatgcgaaacagaaaacaaagttgatcgcattattattgtgtggtgcattggtgaccggtcttgttggttgcggcaacacgccgtccgaaccgtcagaaagtaagaacacttcggaaggagacagcggaaaattatcggtcttagtagcttctaccacaaatacagaagctctccaaaatgtttacaaagggtttgaagaagaatcaggaatcaagaccgatgttcaggttgttcccggagcaatagatcagtttatgcagattgtgcagtcaaaattggcaacaaaggattatcccgatgttatgatttactttgggtcgccgacctatattgcacagattcagccggataagcacgcaagagcacttgatgatacggaatggattggccaggttaaggatgggatatatgaccttggcggaagttatgaaggaaatgtttacggattacccatctcgggctttgattttgcaggaatgttttataatgaggatatttttaatgaacttggtgtcaaagtacccacaacgtatgatgaattatatgatgcctgccagaaaatcaaagattcaggaaaagatatcatccctatatacgagataggcaaacaaggtggaccactgcaggcattttctatgacatatttggcatcctattataaattggacgagggccagaaagccatgaagcaattaaatgacggttcactcaaattagaagattctaaaatcttagaatcttatcaggcaaagatgaaacttcaggatgccggctttatgaatgacaagactgatatgatgacaggaacatgggatactatgtttgaggcacttgccaatggaaaagccactatgtcatttgcatattccaatatgctgccaagtttatatcaaagctttccggatgctaatatcaatatgacagcattagatggtgttgcatcgggaacatgtacgcagtttgcctacttaatgaattccggaaatacagaggctcaggatgcttttatgaattatcttctggaaaaggatgttctagaaaaatattatagcgaagcaaagctactttcatcttacaaagagattacgaatgaactggtaaaacctatagaatctatggtcggcttctacaaagaaggaaattatacattgaattacagtgatggtttatatctttccagcggaacaattattcctttattacaggaaatgcatgtgaaaacaaaaacacctgaagaagtatgccgggccgctacagaagaatacacaaaatttattaaagaaagtggagaggctttgacgcttggtctgggtctgccagaactatgatggatgggacatctccgttcgtgttgtttcttagaattattatgccgctgttaaaaccgatttacgtaacaaccttcgtactggtatttatgttcgtatggaatgactttaactatccattgtatcttttcaaggagacatcaacatggacaattcctatgtcggtatataatttcacatgggcatatggaaataaatggaattattttttgcagacttgatcatggcattagtacctgttattgttgtatatatatttgcacagtagcatattataagagatctgacatcaggtgccgtaaagggagtttcccaaacaaaaggatattaagaaacagcctgtgtttgcctgcttgcaaaagaaattatcaattataatagttaagagatactaaaatctaacatagtatctctttttataaagaaattttggcaaaaattttgataatataatcagcagcagaaccagcagtccactctcctgcaccggtttctatatataattgttcttctaaagtgcccccatgattttcagcatagttaagaaaatagttatattgagaaaataggttctcatattttccatagtaatatgtgcataaataagtgccttgtactcttattgtatcctcataagtatctgttcgtgtataaaaacgaaaagcaaaactatttttcttaatgtcagatatattatgtaccattccaaaagtaagaggaacagtaatgttttttgatttttttaacaaagtgccaaattcatatgtcatcaacttatcatcaatataattaagttcttcagaagatattaaatattgcttatcaagattttctaaaaaatatttttggttacaagaaaaagcattttcaatattttttctgtgttcgataatgtttgattttaatgcatttagatatttgatttttgcgtttaataattgttcttgatgcttatatatttttatcatattttgaggcgagcgatttaaaaaatagtttttaatttcagatagtttcatacctaattcacttaattgtctaattgtaatgaaagtatcgtattgtaaaacatgatagtaacgataaccgttttcatcagttatttctggaagaaacaaacctatatcataataatgaaacagagtatgttttgttgtgttgcataatttagcaaattctcctgtagttaaataatttttatctatcataaattcaatctccttattgactgttgggttacccaacacattattatactattgtataacttaaaagaaaaggagcaaagagaaaatgaaaattatttatgtggcaggaagtcctagaaaaaatggaaatacagttaaagtttatactgaattgaaaaaacatattccctctcatatagaaatggagattatttatttaactgattataagataaatgggtgtatagggtgttcaaaatgtcaatctaacatagaagatacaggttgtgtgcaaaaagatgatgtaaaattattattagataaacttattcattcaggtataattatttacggtactgctctttatgggcattcttatacagggcaattaaagatatttttagaccgtcatgtttcactatttaagtttatatcaggcgaagataaatcggttgataaaatggaaatactatcttttattaaggataaaccagttgctttggttgtttgttgtcaaggtccagaagaatataacacagaattgataaagacacaatttgatatgttctgtgagtcttccttaactcgacaggttaataaatatatctttcctttttgtaatgatgatagtgaaaatactaaattttctacggacactatcgaaaaaatggtctttgatataaaacaaaatataaaataattttgcactgtattgtataaatgatatgacgataccctgttgatatgctataataatccacgtggtttacgagattataagtaagcgcttaattgttgggtaactttacccccactgttttttgtcccataatgatgatagtaaatagatttttactacactccattgataggagataaaaattcactatatttggaggtttcattatggctaacaaacgtgcgccaggacgttccctggacgaatggatggaactggtaaccgagtgcaggcagagtggattatcagatgctgcatggtgtcatgaacatgggatctctcccagttgtttttacaatgctgttacccgtttgcgcaaaagagcctgccagataccagatccagtcccaaaagccagcactcttgatcttacatcccgcaaacaggatgtggtccagattgccatagaaccggagacgcctccggcagaactgggcttgaatactggaaatagttctatgtaccttgacaattcgcatacaattgaaatcgaagcaaaaggcttgctgatacgcatgggcaatgatgtccagccagcccttttgaaaatcttaatgaatgtattaaaggagccatcatgctagcagatatctcaaatgtcgatgcggtctatatcgtctgcggcagaaccgatatgcgcaaatccattgatggattgtgtgcggtcattcaagatcagttttctatggagatcggccatgcactctttctattctgtggacgtaaatgtgaccggatcaaagctatcttaaaagaacctgatgggattgtcatgatctacaaaagactgactgtccaggggacataccggtggccaagggacaaatccgaggtccgaaatcttacctggagagagttcgactggctgatgtcaggcattgatattgaacagccaaaggctataaaaaccagctgatgccagcagaaaaaattgcacataaaagcccctgttttccttgtattttcggcattttcagatcttaaaaatcagctcttttgctcggaaaacatcctgttttctggtataatagatgtatcagaaacaggaggtaaaagcagtggctgacagttccaaagatatccagctccgagagctgaaggacatgatcaatgagcttagaaaaatgataaaaacacttcaggcaactgtcgatgctgccagtaaacgggaagcggcccttgttcaggaaagggacaacctgaaagaagaagcagaccttctccgcaaaaagctgtttggatcttccagtgaaaaacgcacctttgatattccgggacagctgaacattttcaatgaagcagaaatggaacaggatccggcagctgctgctgcagaagaactggaagcatctcttcttgaaaaggcagtgaaaaagcgaaaatccagagctacagatgcagaacgtttcaagggaattcctgtagaaaagaagtatctggatctttcagatgaagaaaaattctgccaggtctgcggcactcccctgaaagaaatcggtgaagagtttgtccgtcgggaactggttttcgttccggcaaagctgaaagtgtatgagtattatagtaaaaactatgaatgcccggaatgtaataggcgaggggttcctgttatcaaaaaaggaaaagacggaaggccccacatgctctatggaatggcatcagctggcacggttgcatgggtaatgtaccagaagttctgtaacagcctgccatacttccggcaggaaaaagactggaaacagtatggtgctgctattaccagggcaactatggccagctgggtgatccggaattcagaagcatttttccttccgatgtatgaatacttccaccggaaacttctggggcgtgaattcgcaatggcagatgaaacacccctgcaggtgctgcatgaaccggggacaatgccgtggatttcctgcatggatttaaaggctatctgatgtgcgatggttacagtggatacaataaagttccggatgcaaagcgcacagcctgttgggcgcatatcagaagatatctgacagatgccattccgaaaggaaaggcactggactatacacagccttcggtacagggtgtgatgtatatcaatcagcttttccatctggaagatgtaatcaaggaaaagcatgcttccttcgatgctatcaaaaaggcacgtcttgaaaaagaacagccgatagtagaaggctttttgtcgtggcttgaccagcagtcgcctgttcgggtaaccagaatggataaggctgttacctacattcagaaccgccggccctatcttacggcctatctggaagatggacgatgcagcttctcaaacaatcttagtgaaaatgctatccggccatttaccgttggccgtaaaaactggctgttctgtgacacccctaatggagcccaggccagtgccattgtatacactatggtagaaatggcaaaggcaaatggagtaaacgtctatcactatcttacttatctgcttgagaaaatgccaaatgataggatgagtgatgaagagttggaactcctggcaccgtggaatgaaaatgtcaaagtggaaatagaacatcgtgcaaacgatgcaaatcaatcatatgtgaattgtcaaggtgctccggctgctgaaaagtagtcggttatttcttctatcatggctgaaaattaagcgcttacgattataatttcatctttcttgtattttgaattttatttaattacatttagaaagaacgatactgataaaatatacgaaaggaagatttcatggaaaaaataatttatggaacatatatatcagaaaaaattaaaggtagaataaaaatagatattgataaattgcaagaaaaaaatcaaagattgcctaaactcgtggttatcttggtaggtaataatcaagcgagtaatgcttatgttaaaggaaaaagtaaggattgtgaggaagttggaatacttaacactactttgagatatgatgatatttcagagaacaaccttttatctaaaatacgagaattaaattatgatgatactgttgatgggatactggtacagttaccactaccgaaacatattgatgaaaagcgtgtgattgaaacaattaatccgctaaaagatgtagacggttttcatacgcaaaatgtgggcaaattatatatcggagataacgcttttgttccttgtacgccgaaaggaattatccgaattttagaagaaattgggttagataatcttcaaggaaaaaaagctgttgttttgggaagaagtaacatcgttggaaaaccaattgcaaaacttctcttggataaaaacgcaacggttaccatttgtcattctaaaacagaaaatattttagaagaagtcagacaagcagatattgtggtatctgctatggggcaagcaaagttagtaaagaatgaatggttaaaacaaggagcagttgttattgtattgatttgcgctttctcgtctccggtttattgcacattactttcacccattaaaatttcatattgcactttttcatattcacttgcacgctttgttctcttaaattggcatttggacgtctctgccagaagacagaaaaagagcatggcactacgccatgctctccagttcctttgctattactttcaatgcttctgcaattgtaatggcatctatctttcctatctgcctctccagttgttcccggttccagaatacatccattaacccggcaagctcgcttccgacctgccaggacggaatgcaaagatatcttccgtattcgtattttccaataatgacatgcatagcacttccgcgtcccttgatttgcgcttcgatgacagttcctgtccgcttcaggttttgcacttctcctgtccatcgacgatcgcttgccacttttccctcggggtttttacaaagatatttcatacgattccttcctacctaaaccagatcaatttcatttgctgcatccatgatgctttggataccaatcgtacgctgtttctgctcgcatccaatcatcaacgccttatgcatcaagctattcagtcgccgaatgctcccgccacagcagccataggctgcttccaacgccgctgtatcaaatatctcctgggtaacgccacactgcttcatacgatcccgtacgtaatcggtcacctcttggggtgtcagcccctgcatgttgtaattaatcacgattctctggcgcagcgcttcatggatctgcatggttagggtctggttcagtgtaggctgaccggacagcaccagtactgcataattacgactgtccatttcaaaattcatcaacagtttcaggtcggcaagaatggcacggctcaggtactgggcttcatcgatcagtatgaccagcgttgttttctgttctttgtacatgctgcggatccgttcttgaatgtttcggaagttctcgattttgcggtaacagggatcaagccccagtccagaagccagatcacggtagaattcactggtggagatggtggtcatgggaagatacaccactttatataggtttggatttagactgtttacaaatgctcgctggcataccgtttttccggttcctgccagacctgtaaaaagcccaatgccgcgtacgtttttcagatattccaaccgcttcatcatttcattataatccgttccgtggtaaaactgtttttccgaaatctctttgtcaaagggattaaattccattccccagtatgctctatacatgtgtaccacctccgtccatggagccataggcgatatttgcccggcgttttctctttgcattgtccagtttctttaccggatagactgtatgaagacgccgggtgctttctccatcataaatatagatctcggacatattttccggacggtaacgaagggagatggtgtgcccgatatactgctgaggcacttcataggcggtgttgaacagagataccgttgctgtcggcgtaacctttctggtgatccggtgaaggaaaccttcttcaatcactgttttctctaaaaagcgcagaccatcaaaatccttcagatatcgttctttgggagtcatgccaatggaagaatggatcccgttgttatactccgtatcaaggaactgatgatagctgctgtttacgtcttccaggctgtgaaaggtattccaatccgtgcagttcatccagcgatctttttccgttctatggctccgctctattttggctttcccgcgagggtgatatggacgtgaatggatctttacgattcctagctctgcacaaatccagttcagctggttgttctggtaactgcagccattatcaacgaagattcttttgggcatcccaaatttcaggattgctttttgaaaagttttctgcatgttgatcgcattatcttcaaaaaagaattctccctgcaccagcaaacggctggcgtcatctataaaggcgatcagataggtctggcggtgcttaccatctacaacaatgctcggtcctactgtggtatccgcctgccagcagtcattggcatgctcaaattcaaaagcaaggcattcctgcggactcatggctgtgcgcgttaagtctgccgacttgagataacgatagacggtatccacggaagcatcgtccttcttcatatatccctgttcaatcagtttctcgtagatttttttccctgtgatgtgaggaaactgttcccggtaagcatggatctgccggcagacatcctccgacagtgccctggactgtccaagatcaatgcgcgctctcgggattaaggcctccagccctcctgctgtgtacttctgataccattttttcaaggtgagtggtgagaactttacaccctttccatttgggagaacatactcggattcgctggtatggcggtaatattccatcttgctggcctgctggtaagtatcagcaacaacaggtgcaatcagggagaagcgaaaaagggccatttcccgtttcatttcttcatttgtcataaaatacaacctccttttgttggtgacttttattgtagcggatgcaacgagccaagaccatgcagaggctatgtgggtggcttgatttacacagaactggagccaaaaaggagtggataagagaccgtattgtgccgatgcaggaacaggggaatttgaaactgtataaaaaagtgggaagacaaccatcgtggcggatacaaatgtaaaagctgcagaaattctctgacgaatggatgagtggcactagaccacaagctttcacggcgaaaaaaagaaggagacgttttctgtacgaatgaaagattcggaggaactggtacaggagttgataggatgttcccgtttctttctctgttttcagaacggatatctctgtatccagacacatggtaatcaaagccagaaaggcttccagcgaatagataaaaaaaggaatgatatccggagtaagcactgcatgtgtgctgctacaggatttgcattgaaggcgcaggattttcatttgcttctccacaagtccatcagattcccatacaattaaatttctggaatagacggcatgacgatggaaggaatgcgttgcgccacatttgggacagtggtactcccagattccataaaagtctaaaatttcatgatagttcttgaaagaatgctcgaaatcgattatcataagtgtgtatagcagataaatttttatctgctgtaggtgtgatggagaatggaacttttctagggtgcccattctccgtttttatgcagcaaccttatcatatcgaaaacataggagccagtaaagtgcaataaaaaatgtactttactggctccccctttttatagaacagagcgaataatttgcaatttttttgatttttagagagcagatttctcgcaaatctatagttattgatgtaggaatgaaccgagatacaaatggaaagttatgtggcgatgtagatttgaatgatgtaatagaaaaagtttcatatatcacgcctgttccaaaaggggttggacttgtaacaagagctatgttattggaaaataccatgcaggcatatagacataatatgaatagataacgataggtgtatttttatttaaaagttgtaataattatatatcactgacggagtgatccagacacggcagtgggaaaatctcttagatttttccgccgtttttagtggctggttcacttcggcagttgagcgagccgtggcgagcgaacatcaagcccccgttatctaacagggaggtactattacaagaaacaagagacaaagcacaaacaaaattcccgatatgcgacgatttacaaagttataaggacttactgcacttcacaccctgcctattctacccgacaggtcgaaaacagcatatcgagacaagaaaatatatgatacaaggtgtatgcttctatgggcgtatgccttttttgattggaggaatgaacattaatgacatggaatttatcgaaacactgaaacaaaaacggaacgcctgcggttattcccaacgcagacttgcaaaggaactacatatcagcagacagaacttaaatgaaattgaaaatggcaaaacaagagccagcaaagaaatgaagcatacgctcctgcattatatcttgactgctgcaaatgcaaacagccctttacactgacagttgattacctgcgtgtccgcttccctactacggacgcattggagattatcaaaaacgtgctggcgatgaaaagcgaatactttattcatgaagattacggactgtttggctatgaagaactatatcgctatggagagattatccttccaaagacgcttctatgggtgttttactggaattaaagggcatgggctataggcacttggaacacgtcttacaggcaaggaaaacaggctggtatcacgtcttgatccgttgcatggactatcagggtatctttaaacgtctggacttggcaatcaacgatatgggcgtactgctggacatagaaatcctaagaaaacgctattacgccaataaggtatggaaacgctcaagaaaatatgagggcgtggacagcgggaaactgtcgggaacaaagggagataccgcaaagaccttttatatcggttcaaagaacagccctatttatttctgcctgtacgagaaagaaaaggagcagagaaacaagggaatacagaccgacatcaagaaccgctttgaaatccgtctgaaaaacgaaaaggcaggataggcggtggaagaacttgttttctcaagaaatcccaagagattacgaccagttccacggtagacctgcaagaagaaaaaaactgccaaagccttataaacaaggatatattgacggttcgtgatagttctaaaaagatacttggataaacgctgaatagcctgccgtttagttatcacgaggtgctgggaataatcccagcaccaactttgtctacagtctgaagctggtatccacatgataccagcttaattataatatcatatcaaaattcaggataaatctattctcttcctttccttcatataaaaaaacatccctaaaatagtccatgcaatcagacaaatataagattctttacctagagaacaatttaatcccggaatcggaatcaataataatatcgtaaagaagaccgctaaacaaacaccaatccaacccattatcaaaaatgtaatggatttaccttcctttgcacatttaatagttgccgctgacgtatatccatatccaattaatgcccctaaagatgacatatcaactaaccatcccaaagcatttcttccgaaaaacggtgctgctattgaaatcaaaatcaaaaatacaattgcatttctaggtgttttatacttcgaatccacttccccaaaccatttcggaatcacaccatctctcgacattgaaaacagtaaacggctggtagcaatatagaaaccaacaattcctgacaacacagccgccagaactgctattcctataaaaaatactcctgcttttccaagcaattcatatgcagcgtaaaacgttggcaatgaaatcaaaccatctaaattgcttgcgtcttctatatattcaacccatgatccatagttatccggtattacagatgctgtcactgtatttaaaatgctatatacaaatccgccaaagactattgaaaacagcattatcatctttgtctttcttggtgaaaatttaaattcttcagcaacctgtggaatcgtatcaaatccaaagaaggcccatggtgatataataattattgcaaaaatactagataacacagatgttttcgttgtatccggaaataatgggtataaattttctaatgaagccttcggacttacgatagcacccacaccaataaccacaacaccgaacacaagcatgattgtcagtatcacctgaaacagccctgcaaactctacgcctcttatacacaaataaccaaataaacaaaccgcaaaaatagctaacagcacttcacccaaatatacttcatatccggtaacattgtaatgaaatccaacctgaaatacattattcagtaaatttcttccaattagtgccaatgctgtagaattcattgagataggtaaaatatatgctaacgctaaaaaccatgcacaaatatacgaatgcttacctccaaatacaattcgtgtatatttgaactctcctccggccaaaggatatcggttaaccatatagttgtagttaagtgcaattatacccataataactatggatatcaccattcccaaaagagttcccatcggacctgcatttctaaggaatgtctcacccggcattacaaatgcgccccaacctataatgcatccaaaagcaagagcccacacacttaaaggcgaaaattttttctcaagcttttcttcttttttcatttttacattatcctactctcgctacattgttattctgtatcttataaagcttttttatatagctctactaaatctctcaatgttgtttgtcttggattcaccaatacatttccgctctttaatgcatcctctgccatttcctgaatgcactcttcagtcacacctacttctgacagcgactgtggaatattcaactgagctgtcaatttttttacttcttcaactaacatttccgccttaaacgaagttacattcttatttgtttcatgtatataatcatagatttttttataacggccattgtctgctaatgcattaaattcaagaacaaccggtaacaaaatagaattggcaacaccgtgtgccacatgataatatgcactaaccggatgactcattgcatgaacatttcccaactttgcccaggcaaaggaaattcccgcaaaagtacatcctatcatcattgcacttgccgcctcagcatcttgtctgtttgctacaaatcttctaatatttttaccaatcaattccattgccttttctgccatagcatctgtaaatggagatgcattcgttgacaaatatgcctcgattgcatgaattagcgcatctacgcctgttggtgcagcaatagaagccggcaagctcattatcaattcgggatctaatatcgcatatttcgggagaagttcatagctgattacagataatttataatttctcgcttcatctgagataacggctgacgctgttacttcacttccggttccggcagttgtaggaatcgcaattatcggaacaatgcttcccggaacattatcaaaaccttcatattctgtaatttctccaccaaaaatagctagtacacctaccgcttttgcaacgtccattgaacttccaccacctaaggcaacaatagctgctgctccggaatctttatataattgtgttgcttcatttactatatctactgtaggattcgctatgacatctaaaaattgtgtacatacaattccttgcgcttctataatgttactgatttttttaactactccgactgcttccaaaccgcgatctgaaacaagaagtacatgttctgatttaactgcccgaattttttctggaagtgtttttagactccctacaccaaattctatattttggggtatcttaaaagtaaaatttttcattgtcctacctcaattttcattgtttttctttagtgcccacctgacagtgaattccacgattattgaaataaagcgcaatttggtttacatgatcttggaatgtctttctatcaattttcaactcctccatcttatatggaattcccaaagactgatatttttcttcacctaatctcataaaactcaaaagctgcaaggtcctaacattaccattcagtttatcaataataaagtccgctgtcttttctatattttccatatcgtcatttacgtttggtataacaggtattctcaaaatcatttctcttccgtcatttgcaagcttctgcagattttctaaaatcaaatgattatcaacccccgtatgtttcttatgtatttccgagttcatatgctttatatccgaaatgataagatctgtgtatggcaacaccttttctatctgttcccatttcgcataaaacgtcgattcaatacatgtctgaatgttctcctgtttgcatgctttgaataattccataacaaaatcactctgaacaaacggatctccaccggaaacagtcacaccaccgcctgatttatcataaaagcctctgtcctttctggtgatttccatgcattcttctactgtcatcatctttccccaggccttaatcgcttctgccggacaactattatagcatttcatacaatttgtacatacatctctatcgatggactcaattattccattttcaaagtttattgcaccttccaccggacatacattttcacatgcaccgcatttttccttggaaatacatttacttgcgtaaatgcctacttctatattacgatgccagctttcaggattactgcaccactcacatctcaggggacatccctttaaaaataattctgttcgaatgcctggaccgtcatgaatcgtaaatcgctgaacattaaatacaattccttttaccataacattccacttcctctctctacataccttcaggtttacataaataccaacaaactacgaattaatgtgtttaatcctaccgctaaaagaacaacatatacgaaacgcaaaaactgttctctattaattttatccaagaacttaatgcctaaaatgaaacctaccgctgcaaatggcacgcagactaatacggcactccacaaataaggcgtccatgcaccattacggaactgattaattgagttcaatatgtctaatgttgcccacaaagcaatcattgtattacggaatctgattttatcttttactgcttcaagcgtatacaccgtaatcagcggtccgccgatattaaatgcaccatgtacaacaccaccgataatcaaacatgaataacggaaaacttttttaggaagagtgtctacttcatctccacttttcactttcttaagtactaaaggacttactatattctgatatatcttaaatgctgcaattaaagtaaccactaaaccgataccaactttagcaacgttaggatcaataatataaaacaagtactgtcccaaaaataatcccggaagacatgccactaaaattttcccaagatctttccatgaaatattcttcaaagatttaagagttaaacctacaacgaaaattgttgacataattgttccaaaaggaactcctgtttcgatacccaaaatactggtagcaaatggtgctgaaataactgtagaaccaaatcctgcacttccttcaacaaaaaaaccaaatatctgaattatcgctaataatataaaacccgtctcgaataccatgattttttctcctcattcatcctttatattttataggatccaagagcctgaactcaggctcttggatttttaaattttcattttcttaagattagaaatggaactctgtacggtcaatcaaatcattctggagcggtgttcccagctctacgaaatatgcactatatccggcaacacgaacaagcatatctttgtaattttctggattcttctgtgcttttctcatcttatccgcactcataatgttgaactgtacatgcatacccgctttgtcaagatattcatcaacaaaacttacaagattgtcccttccctcaacacctgatacagcctcttctgggaaacgtacatttaacaatgttccgttcatagccaagctatgatcaacttttgaaaccgaactgataagtgctgttggtcctgacacgtcatgtgaaccaccaatagtatgtaccggtcccatattatctgacaacggctcaccttttttacgtccgtccagtgacgcatttgttgcaagaccaagacctacgtttgcatttactgtgtaaacaccaggaatgtaagaaccaccacgcgggttttcaccaacattaaggtttctgcagaaactttcgtatatgaagcggaacaactcatctgcataatcatcatcattaccatagtgatgaacttttgtactgtttaccaacgcatataactgttcatgaccttcccagttatcgtatattgcctgcagtaactcgtctcctgtaacggatttttcttcaaacatcagctgtttaattgtagcgagagaatctgcgcatgttgcaataccagctgcctgtggtgctgtaaaattgtattttgctccaccttctgtgatacattttcctctttcgatacagtcttcgaacagcgaagaaatatacggaagtggtttacactcacggtgagccacatcaattacatcattgcttcctctgatttgttcacaccaataagcaaactgcttgtcaactgcttcaagtacttcatcaaatgttttgtatgtacgcaaacttccgtagtccggtccaagctgtccttccatgtgcataagacgtccattattcaatgccagttcaagaatctttgctgaattgatatatcctgcgccatgccatccattttctttccccggaaggtttggctctacacacccaacaacgctgtaatctcttgcttcttctaatgtgtgtcctttattaagcattgctttgattgcaggaccgtcattgaatacctttggatgaccaaatccggcacgaatacattcaattgtctttactttcaattcgtacggtgtattttcatgcatacgtacgcaaagccacggattcatcatacgtgtatgagcagaagcctcgatcatcatcattgtcagatcatttgttgcatcatttccgtcacgatcaactcctcctacaacaagactttcgccaccaaatccacgaccattacgtacgacaacggtactcttatcttttaacttagtcggattattcatcttaacatactgaacttcaatcaattcaagagcaaactctttagaaattgtcttattcttcatatctgcctcatagaatggatttaaccactggtccatacgtccgtaagaaatagaatgtccgttaccttcaatctgaatcaatgtagttgccagattgaacaactgtactgcctgccagaatgtctgcggtgctccaccggcaatctgacgacagtttgctgccattgtttcaagctctttctttctgttctcatcctctgttttcccagccatttcttcagcaagtactgcatatctgttgatatacttctttactgaatcaagcatcataaccatagctgtaaggaagtcttttctttcttcgtaatcttcgtcactttcagttaattttgccaaagcatcttttgcttttgcctgaataccatcgtatccaagtttcattaacatttcataatcaacttctgtatgaccgacacctgcataatgataatcgtttgtcacataaactttcgcacctgcttcagatccttttaactgatcctcagtcaatcttgaattaatcaaatcgtcaactgttttacctctccagtattcagcaatctctacaatctctttacgatcctcatcgtttctaatgtaaaactgatcatgtgcacgctcttcaaatgggaaatgtaaaacctcatcaataagccattcaactgaaaattccggataaaccggagctgcctttgcaggcgctgcaatttcacctacgataagatcttcgtcataaatatacaacggaatatttgtcaggattttatcaaatgcatatgcacattgcattttacggctggcaccttcatgctctttataagattctgttaccagtttcattctgtcaatatcaatatcataaggtctttccaaaaatgtttttcttagacgatttactctcggaaatggcgaccactcttcatgatttacctgatatccaagacagtaagaataatcatacggatgtattccgcttgcattagtgtgttgaactttcataaaatagtcctccttgaatttttaatttcatcttcatcacgtgattttttgttcttttcttgttataagattaacatactccatatacaaatttgaaatattaatatatgataccttttcataacaaaatattatgtattttcctttctttatatcaatctgatgattttcagctgatttgtcatttgtttttagatggattgtacactattttcttcacatctataaaataccattcacctttttgttatatggatgtgttgttcggcctgtttataattttttgttatatgtacatattgtataattctatttcacatttccagggtttgtatgttattttttatgtaacgattttatttccagcggtacgttaaaaaacaccgccggaatgtgaatggaactattcaacaaacaaatatttcagttaaaggagttagaaaaatggagaacatattaacaactgtagacgaattagtaaggcgctctaaagaagcacaggctcagatcgaatttacatcacaagaacaagctgacgccgctgctcgtgcaatttgtaaaatcgtgtatgacaacgcagaaatgcttggtccaatggctgctgaagaaaccagaatgggagatataaacgataaaatcacaaaatgtcgtatgaaatcctccttaatctggcaaagtatcaaaaacaaaaaaacagtagggattatcgcaaagcacgaagatcttaatgttcttgaaatcgcaaaaccaatgggtgtagtagctgccattatcccctctaccaatcctgttgtcacacctatgtgtaatgccgcatttgctttgaaaacaagaaactctgtaatttttgctccacatccaagagctgttaaatgtacacagctccttgtatcaatgttccaacaggaactggagaaactggatcttccaaaagatctggttcttacccttgagaatatttctgttgaagaaagcgcaaagctgatgagctcagctgatattgttgtagctaccggcggaccgagtatggtaaaagcagcttattcaagcggtaaaccatcactgggggttggacagggaaatgttcaatgtatcattgatgaagatgttgatttagcagatgctgctgaaaaggtcttaattggccgcagctttgacaacggtcttatctgcctcggcgaacagaccgtatttgttcctcgcgaaaaatatgatgcatttattgaggaaatcaaaaatcacggtggtttctatatagatgatgctgatcaggtacagaagatcagagatggtatcttcccagagtgcggacctcttaatcgtgatgtagtaggattaagcgcatccgatattggaaaagtaattggtatagatgttccggaaggtactcgtgctatcgttgtcaaagctgagactgccggttctgcggaacagctttgccgtgaaaaactgtgtcctgttcttgcagttctcccgtatgacacatttgaagaaggtataggttatatggtagagaaccttgaatttgaaggaaaaggtcacagtattgcggttcactcaaatactcctgaacatgttgaatacgctgcaatccagtgttctgtatctcgtgtggtagtaaatcaggcttcaggaacaaccggtggcggcagcccgaaaaacggatttactccgacaactacattgggatgtggttcatggggaaataatagcttcagcggtaacttcagccacgtgcatttgatgaatattactcgtgttagttatccgtttgctgaatcttaccttccagatccggaaatggcatgggattaatttgaataaactattaattttttaaaagtagaaaggaagtcttgttatggattatttagaaatagaaggaaaaaaacagcttaacagatttggcattccgattaacgacagtatacttttaactgaaaatgttgatttaacaaaagttccatacccttgtgtacttaaaggtcagattctttcaggaaaacgtggaaaagcaggtgctgtacgggttgtcaaatccgaagaagaattaaaagaagtaaaagaaatcatcgaaaagattactatcaatggaaaatctatggaaggtattattgcatgtggatttcttcctattgttgaagaatactatatgggtatgactttagatgttaaaaaccgtgcagtgattatgctctttactccttttggtggaatggatattgaggagttagctacgacttcaccggagaaattaatgcgtttagattgtacagaaggatttgacgaagccgctttccgtgaatcagcaaagatttttgaattgccggatgagcgtttgaataaaattgtagatattgcaaaaaaactgtctactgcttgctttgcattagatagtacaacaattgaagtcaatcctttagcagtattagaagatggaagtgttgttgcaatcgatgccaaactggtaattgatgacaacagcctgtaccgtcaggaagactacacaattctccctcgtacatcccagcagaaatcactccaggaactagatgctgctgaacatgatcttacatatgttgaattagatcctaatggaaatattggtacaatggccggtggtgccggaatcggtatggcaacaatggatactatccgtcattatggcggtaaagtaaacaacttccttgatttgggcggtggcgtaacatccgaaaaaacttatcaggcaatgcgtattcttcttcaaaacgaaaatactgatatgattcttgtaaatgtatttggcggaattaataattgcgctgatatggctgacggaatcgcccgtgcctacaaagagtttggaaacaacaaaaaagtagtagttaaaagccgaggcttcaatcaggagcagggatgggaaatttatgaaaaattagggttttctcaaacaaaatatggtactacagacgaggcagtacagctcttattaaacatgaaggaggcataatgaaatgagcattctgattcataaagatactgaaatgttgatgattggaatcacaggaaaacaaggtcgtatccattgtcagcgtacacttgaaagtggaacaaaattgttagcaggtgttgcacctggaaaagctggcgaggaagtaaacggcgttcctgtatttaatacagttgcagatgcacgagcacagtttccgggaatcgaatccgctctcctgattgttccgagacagtttgtgcatgatgctgcaattgacgcccttcacagtggcatcaaattattagtaattgtaactgaatttgttcctgttatggatacattacatattgtcagcgaagcgaaaaaactaggtgcaagaatcgtgggaccaaatacaataggtgtgatttctcccggtcaatctaaaataggtattatgccggattatatttacggaaaaggccatatcggcattatttcaagaagcggaacccttactcacgaaacggcctccaacttaacttttaaaggctatgggctttctacttgtatcggaatcggcggtgacccgattattggtatgaaccatgccgatgttattgaacttttcgctgaagatgaggatacagatgcaattgttatcatcggagaaatcggcggaacaagcgaagaaatggcagccgcaaaaatcaaagaacttggattaaagaaacctgtttacgcttatatcgccggaatgtacgctcctgaaaacaaaaaaatgggacatgccggtgcgattgtaagcggcggaatgggaactgtaaaatctaaagttgccgcgctagaagatgcaggtgttactgtttgcccaacactcggaaaaatcgttgaattcatcgaagagcaaaatattcatacaaatggaagattgcaaagcctcgtaccaaaaattgattaatttctccactcacaaataaaaggctttcaataaagtaaaacaaggggcactaatcaagtaaatttgatagtttcccttgttttctttatcttctgccgttcacctcaacaacatcgccaatataaaagctattattcagaataaattttagccgtttttgcattaaaattcattataagttgagactgctctacttcttgttccgcaaattcatctccacatttatcaatcacattatcgattatagactgcatttcatctgtaatcgtactttgccgatgcaatgcatatgagaatatcctataagtattacatttactttttattttataataattaacgtatttactttcatcattaactaaccaatacggtacaattgttgaaccagcgcctttttccacaaaagcatgtgcaatgtcccagttttttgcgacaaatatcacatttgcagccatgccagtctcctcaaaaatcggacgtaagaattctgtatatgctttcgccggacctgaaataaacggcaaaccgcccaaatctgacatatccacatatccatcgcacttctttgacctggcaatcaaatcatattcattatttttaggaatagccaaatagaactcttcatgacaaattgtataatgtacaatattggggtggtaataaactgccggtatgaacaacatatctaattcttttctcagcaacttacttatcaaatgttcaaccgaatcctccatcatgcgtacttgcttcacattagactccataccataaaggaaatcactaaaccacggtactgaatatcctgtagggcatccaaagaaaactctttttttgtttacacttgctgcatccttcattttttgcagcattttttcatactgttcaagtaatgctgtcccttcttccaacagcacctcccccgcttctgtcaaagtacatttgccgcctgaacgctcatataaattaaaagataattctttttccactcttttaatatactggctcagtgccggttggctaagatacaatacatcggctgctttctgaaagctcccttcttcttcaatcgccttaatcatttgtattgtttttaattcaatcattccatgatgcctcctgactctttttcgtactttatatcagtctatttcttgactaaaaatatcattttcacattatttctacaagtagttttcgcaaaccaataagccaagagcgataaatttcctgtcatcaaaacttttataaaacaagactggcaatttctctttgaatactatcattggaaatatcaatgtgatattggcatttcctatatttcagaatgaatgcgatatgatactggcatttccacttagtgtgtgatatgcttttattgtccatttggaccacctcctatgtttgagtttggcttgcgatactactctcattgtatcataggatgttttttattgacatcattatcgtttctacttacacgattcgtcctagaatagctgggggattaggattttcatttatatttttcttaatcacctttgtcacctcaatccattattttttctataattatctaagatattataacggttccatatacccacaacaataaattcttttggcaaaaaaatcgccacccttcataagtgacgatttttctttgttattttattgttattgaatggactccatttcaagtagcagcaacttcacaaatcggagacgcggttgtaatcactgcactcttagcgcctttgatgactaacctgtaggtcaaaaattcgtaatccctcaatgcccgcttcctgaaaacagatatgacttgtaatattttctcatctaatttgacggaagtgtaaaataagtcttcacctgctcttcactgagtccattctccatccccaacataatttcattaagctgctcttctgacaactggtctgcatagcgtaaaataagataatacgcaacggacatcacccatgccagaaatgtgtttcccgactaaaacaaccgttgtctttattttctcaggttcgaagagttcatcaggcgaaaaacactcactgttatatctttgcatttcatctaactgttaaagaatctcttccttttatatttcttagttatttttttaaaagaatttaaaataatctaatcgagcttcccctgatccaataacctctattgtcaaatgtaaattatttcctatctccttatcaagtatgcatgggaacatacaataagaccgccaagaacttcctgtaccttttacttcacaacttccaatgattgttccgtctttttgttctctgacttcaattcttgctccttgttcactgctactgcttgcaaagaaactgatccctttctttccttttgtattttctaggttggggtaccaaagagtccccttttctgatgtgagcatatcgaaaccatatctgggattttccaccttcttcatctgctcctgacacatacaccactggctctgaattttattccagtttgtatcgtaatggcctactccatactccacaattaactcatctacaacaagttctttattcgccctttgatgcacataacaaactccagatgcgcgatgcaccattgttgggtcaaaaactgtaaacgaattaaaaagctgtccattatattctacataagaaccatggtcctcacttgcccctgtatttccaataaacttataaggtccatatattgagtcagaaatcgcataaaaggagccccagcttaaataataagttcctccaattttatttagagatgccttatcatccgcctcatgatccacttgtagtcttctcggtttttcagctaattctatcctactttctgctaatttagctatataataacctgcaccctttccatacgcccactttggtccgccaaaaacaatataactactgccgtcctcatccgtaaacaccgcaggatcatactccggtgtatttgttaaattcccatctaaaattgggcttcccttagcatctatgtagggaccctctggatgatttgccactgcgactcctgtctgaatatttttattagagtaatacaaatagtattttccatctttttctaatgcatcgattgcccagcaatcactgcattttcccataaaaaatgattctggcttaactacacactctaaagtccactctctaaaatcgacagtagaccaaatatgccagtcttgcatgtgatacgtcgtattttccacagaagtgtcatggctgcaaaacatgtatatcttgtccttaaaaacctgcagatgtggatcacacactccttttcctggtattacaggattcttttcacttttgataacagttccttccttcactttaatgacctccttatatattcttttgttaagatcattataacctttgattattatataaaatatagattatattcagtgaatatgtgaacaatttaatgtatcagacagatatcaacatatgaggtgcactaatcgaaagaagcatggacgttcgtttaaaaaattttacattaaatagttataaggacgaagtgctaattatctgccctacctgtagaaacatgtattctattgacaggaccacagctatgttcttttaatggcatcttgtttcatcgtattcaggacagccccttattgtggatcatattaggtttcctccagaaacagtgcctggctcataaaaccgcaccctgaaggaaccgtataatccgttattttttttgaaaaatcaaattggtggagcctttcaagctttcgcggccggtaaggtatcttcctgattgtcccgtcttcaatggcatctcttaatccaggctctttccagcacttctctaaaagaagctgatacatctcggttctgatcacactttcagacattaccagattcacaagctcgtgagggtcgtttcctaaatggaacagctgctctctccccccattcaccatatagatgtatttccatgcccctttacgtaccatcaacttaaactggtcggaatccggtcttccataaactgcaaacagatgctcccttctctccccgtccataagaagaacaccgtcacgagcatctgcttcacctgcggctgccgttgctatgccatataaatccgccaatgagacgaaatcctccctgatttcaccgcgttccattttttccggataacttaacagaaacggaatctttacggattcttcaaaaaaactttccttctgccatcccccatggtcaccggccatttctccgtggtcgctgaaaaagcagattaatgtattgtcagcctccccaccggcatccacagcatctagtatctgtccgatacaatggtcaatataagtgatttctccgtaatatctggttttaaagttcctcgcccatgcatcattaatttcatctgcataaatcagataattcatccactgtatctgttcatccatttgatccgtgcacgcgcttcctcgtattggattttgcatcccatccgggtcatacatcctgttatagggtatcggaggagcacaaggcgggtgcgggccaacaaaggaaacaaatccgaaataaggcctgccgtccttcctgtttatctgttcgacagctttagctgctgtaaagccttccacagtatactcagccggcattggactcatctgcgggacaaaatacatattggtcctttccccgtgcagctgttccagatgtgcatacccgggatgctccttcatgatgaaagatgcatatccgtccttctctttgacccgtggggtgtcatacatctcttccgtgtgaatctgcacttcatagcccaaatcttcgtagacatccggacttgtgtggaattttccaatgccccaagtccgatatcccaattttcccattctcctggcaagatactcaccgcaatagctctccactcccatctgcccgttactatggatgggggaaggattttcattacagtagcagcctatattgtaaggttcccttcccgtcctgacaacatatcttgccggaacgcagaccggacaagaggaatatgcattcgtataagcaatacctctttctgccagcctgtccagattgggtgtctgtatcacccgattgcccagtgcaccaatgcagtcaaaccggaactggtcacacataatatataaaatgttgggtatgtccatactaattgcctcctttaccaccagcgtattaagtcagttacttcattccgcagttttacaaacgctttatccgccaccttccttggacgcggcaggttgttgttcaattcctgctttacatgggttggtttgtttgtaagtaccagaatcctgtcacttaaataaactgcctcctcaatattgtgtgtgatgaaaataaccgttgtctttgttttttcccagagcttgaggagttcatcttccagcttatatttcaggttcagatccagctgcccatatggttcatccataaggagaagatccggctgcgtagagaatgccctcgctattactacacgctgcagcatgctggcagaaagctcctttggataaaattttctaaactcctgcatatttaccatttctacggcttcatcaacacgttcttttataatctccggggctatcccttttatttttagtccatatgctatattctcttccacattcagccatggcaacgcagagtactcctgcagaatatatgccagattgtgtttcttaggatttacttcttccccatcgattagaatggaaccgctgtccgtttccaatattttcgtcagagaatttagaaatgttgtcttcccgcaccctgtaggacctactatgcatagaaactcccctctgtttacagaaaaggatatcttatccagaacgagcagatccccaaatgattttgtcaggctgctaactttaaccttcacatcactcatactgctttctcctcactttcccggggaatatctgtaatactgctgatttcttcccgcaatgcaagaaactcgtcactcaccatactccttggtctgggaagattgattttatattcttttgctacaactgccggacattccgtcaggataataatgcggtccgcaagatacagtgcttcttccacattatttgtaacaaagataactgttcgcttctcttttgcccatattttctcaacctcttcctccatcatatatcttgtctgtgcatccagatgcccgaatggctcatccatcaggataatatccgggtcattacaataagccctggcaatcccaacccgctgacacataccgcctgacagcttgaccggatgatggttctcaaatccatggaggcctactaaatcgatataatactgtgccttttccctgcgctccttttttttcatccctcttgccctggggccaaattctacattccccattaccgtcagccagggaaacagagaggttgtttgatataccattccgatcccaggatggaaaccggatgattttttaccatctatgtatacatttccctgagtaatatcttctaaccctgcaatcattttcagcaatgtggtttttccacattgacctgccccgaaaagtacgacaaactcgtttttttcaatatccagattgatgcctccgataacttctgtcgatttatcatttacatcaaaacttttctttacattttccagacgcaccactgaccgttcttctattgtccccgctctttccatgagcataatctcctttccataactctcataaaggatgccagtatcagccccacaattcctatagatatcattcccatcacgttattcaccatattcccgctctgcatgccggacagtattaaccagccgcaccccgatgtagctgtaatcatctctgctgcaagtactgccatccagctcgttgacaaagaaacctgaagaccgctgaaaatatacggtacacaggaaggcagtacgatggtcaaaaagattctgtttttcttaagtcctagaacccttgccactccaatcagctcctgacttacattttcagcacccgccattgtattcataaccatctgtgcaaatccgcctacaaatatgatgaaatatattgttacatttcctgtcccgaaccataaaatagcaagaggtatccatgcaattccagggattggttttataatattaaatatggggttaaagattgcttttccaagttttgaagcccccataatcaaaccgaccagtgtacctgcaacagatgatagaatataccccacaagcactctgctcaggctaattccgacatgtcctaaaagcgtattcttgccgattggttcaaaaactgcatttgccattcctaaaagaactttaaacggtgccggaaatatggttccaaatcttgttaccatcacagaaatctgccagataactagaaatgtaaatattccaagcgcacctataaagattgtctgtatctttttagactgtaagatagatttcactctaacgccccccttttacgattcttctctctgccatgcccagaagccatgagaacaaagcgccaaaaccgccgatcaccagtacccccataaacaccagatctattctgccgaccatccgccccatttgaatcatatatcccagacctttagtggatgccactaattctgccgctactaacgtaacccatgaagcattcagcgaaacgcgaatacctgcaaatatcataggacctgcagtcggaatagcaatcgtctttaaaatttgaccatttgatgctccaaaagtttgtgccacccatttatgtaccggattcatctgtttgatcccactgtaggaattaataattgcaggaacgattgccgcaatgacaatcacagtaacctttgacataattcccaggccgaatgccataagcataaccggtacccagccaaccggaggaattggttttatcagatcgaacagcggcttaaaaaacatatcaaacttttcaaaccatgccatacagattccgattggcacccccagaatgattccgatacagaagcccagtacagattcctgcagactggtcaggatgtgtatacccagcacgctgccgtccggatttgtattggtcagtttataaataaaagtttctacgattgtggcaggacttggcagttttttttcaggaagcagatgcaggatatccgtgagaagctcccagaacagaataaaaacagccagtgatatcacagagattataaaatatttcttattttcttttttttgcttcatctcatcacctcaatttctatatgcaaaagggggatgcaccatcctgctccccctcgctcttgtctattctcctaaagcagctttccagatatcgtctacaatattctctttaaaggtttcacattggtcagcttcaatctgtccaatagatgcatagaaatctgccgcatcggcttctgccatgccatagtccatcgtcttctgtacatccgatgttatgaagatgcgcagatcagcctcttctgccacagtcttatccgtcacctccagcgcattctcactataaaatttctttatctgatccatttttaattctttatcggcttccagctcatctgccgcccggtagcatagcttcataaactttattaactcaggttttaaatcattatatgccgcctcagaacagatgacatccgtgtttgttgaactaaaatcctgtaatgtggcaattggctgccatccgtatttatctgtaactgccgtcgaccagggggttggaagcgccacgatgtccccttcccctatctggaatgtttgctcacaggtctgataatccataggaaccatgctgacctcctcggcacttacccccagcgattccagatattctaatgccagctgatgcgtcgaagttcctgctgaaaataatattgtggtaccttttacagtatccatatctccataaacatcgggataagtaggattgaacccctgtacatccagaatctcactgtcctccctcacaaataaggtatcaccgcctgtatcactggaggttccgataatctttgccccattattcacagaaccaaacacatatgctggtccctgaaacccgacatcccaaagtccggcagccaatgcttcattagcagcagccccgtttgcatacagctccacttccagttccagaccctcttcctcagcccagccctgatccataatgtatgacagcagcacaccattaaaattaggcatagactgcactcttaatgtagttagttctttacctgattctgaggtctctgcctttttgccggaatcctttttctcttctttctgcccctgacatcctgtcaatgccgttgcgagtaccgccgttgccaataacagactcatcacttttttcttcatattccttttcctttctcttactgattgtttttaagctgtctaaattatattcttttttcatttttactgctattccaaaaaagtagagtatttaacaatttttcgtcctattgtactatacaaaaataatcggaaattatctttatcacaaatccgtatatttaatatcacttatccgcgtattttttatttcgaattactttccagttcttttttcttgacattccttttttcttatcagaaactagagttataacttatttatcgttttcacataaagcaggggataccatgagaacgcatatttttagatgtaaaaaaaccttgggtttaaaacatatactatctattctttttattacatttattttatctgtatctgtattaatcatttttccttctttttacttttataaacagcagctgattgagaatatctcccagggacgtattgataccctgtctcaggtaaatagcaatataaataaaataaaagatgaaattgtaacaatatcagatatgttcttttatgatgaagaactaaaccagatgttataccaaaaagacatatttaaatctcccgagaaagagttaacatatatccgcagcctggatcgcaaagtcaggaggacgctggctcattactcttttgaatacgaaatgcagttgattacagataatggactaatatactccacagattccgaaaaaatggatgaaccgccacaatataaagaggagttgtggtactacaaagcaattggttcggcagaacagttatactggctttccagtcttcgaacaagcagcagccgtttgaatgacaaaaactatttttcccttcttcgttttattagagacgaagattcccggcctgtcggactcctgatgattaacatacctgaacgctttttatacaatacctatcagaatttgacttcagacgatggaaatatctatcttgtagatacagacggacaaattatatcccatacaatagaatccatggtcggacactatttttacaaaatgccggtattctatgaactgtttggggataaaaactctgcaacaataaaaaaatcaggagtaccctaccttttttccaagtattcaacagatgcttcctcctggattgtagttgaggagatacagatgtcctccattctgcagcccctgtacagaattgaaagagcgatcctcctgattgcatttttggtatgcgttatcagcattttaacctcttcttggattgcagccgctgtttcccgccccctgacagaagtatatactgttatggtgcaggctcaaaatggaaattttaatgtggcctttcccagaaaaggctttgccgaaacaaggtggattgcagatgcctgcgagaattttgtcataaagatagcctctttgcttaatgatataaagaaaaaagagcacttgaaaagaattacggaacttcattttctgcagatgcagattaacccacattttatgcacaatacacttttcagcataaaatgcatggtggatatgggacgttccgaagatgcctgccggatgatagatgctctgaatgccatgctgaaaaatattctgaactgtgaacagcagttagtctccgttcaagaagaggtcgacaccctcagacagtatacgtatattttacagcagcgttataccaactctttcatttttaaatttctgatagatgacagctgcagggaattattaattctgcggtttatactacagcctattattgaaaattctgtattccacggtttttctaataacaagaaaaacggaatcattgtaatcagggtgaaggaaaccaaagaacatattattttaaaagtaactgataacgggatggggatggcagaggaagtcattcaggagattatgacggatgataaaaagaagaatcatatcgcccttagaaatattgcttcccggctggagctgcattatcacaatcaggccaaatttgaaatatcaagcactgtgggaaaagggacatccgtacaaattacagtacctaaatatacgatttaaaatgccggcacaatcctattaaacaatatgattgtattgattcgtatcagcacggcagtgttctgttgatattaaaccggctgttgcaccagagaggagcgaaacctatgaatatcttaattgcggatgatgagacaattatacgcgagtggctgcagcatacgatagaatcttttgattttatcactgtccacgccgatactgcttctgacggacttgaagcattagaaaaaatacgaaaaacagaatacgagattatctttattgatatccagatgccaaggatgaacggaatcgatcttatacgtgaaatctatagcgtaaacagtaatatcctcactgtcatcttaagcagccatgatcagtttgactacgccagagaggttatgagaaacggtgcatttgagtatatgctaaaaagtgaatgcagcagacaggctctggaggaattattgaaaaagtgtagtgagcatttacttagcaggcaggccagcattgattccttacgaagtgctttcttaagcctctcgcttcagccagataagcaggactctgcaaaagaccagattgacgcccttttctctgagcttacagacaaatcttattttactgttgctctttgtaatgaaaacattcctgtgcacatatctgttcccatagccccggcagacggcatctttttttgcggttcgcttcttggcctggaagcaaacctgcattactatgtgtttgaatatgtacagctttcggaatctgaggacttccgtaaaacacttcacctatttttacaggaactgcataaccagtatccaaaaatgaccataggatgcagcaatgtttaccattataagtctgaacttatcatctccatcaatcaggcccgcacagcttacgaacagcttttttactcttcatgcccctatatgctgtccgataagcaaaaaaacagtcttcccataaaggaatttaatctcttaaatgccaaagctatagaatatattcgttcttatcaaaatcaacttttttttcaaaccatgcgtactcttgaaaaatggattttggaacaaaagcctgaggttgattatgtaaaaaatacttacgggaatctgatccatacactgtatctctgctatagtaaggataccgacgaactacccgatatgctgagcctgataaaaaaacgtataaatgatatctcctcatatgttatattgaaagattatatatggtcactcatacgtcaatgtatgttatcactcccggcatctaaaaaatacagctcccatgtaggggctgcattaacttatattgcggaacactatgctgagattatatcgttaaaagaagtggccgattccatccatataaacacggattatctgacccgtctttttaaaaaagaaaccggcaggaatatgagcacgtatctaatggattataaacttgacatggcttccttcatgctgaaaaccacaaatctgcaaatcagtgatattgccatgaatgttggtgtgcctaatatcagctatttttcaaaaaaatttaaagagcggttcggaatgcagcctattaattaccgggcaatcagcaaggagtaagttttttcttcaggtacagtaacttagcctgtctgcctctatataggagacatacaagtatggcacatcatttcccctcataagtcataggaggctgaaaacaaacatttgttttcagcccatatcatcatacagaccaccctaaatgactacagatagtttttcatattcttttttatcagttcctgataaaacgcttcccctactttcccatccttaccataacgtccaacataatccgcaagatcccagctgattcctcctgacacatctttttcattcccggtctccggtatggtgggatgcgccgttttcaccctgcttgtccttataagccagcagtataactgatatcgtaagtcctgtaccaccttctcatattccggttcaaaatacaggttcttcaattcataaggatctgcctctatatcatataactcaccgaattcctgtccctcaaactcaggaagatactgtgtcagcttatactttttggtatgtatggtcttcgtattcggattttctgttaccgcaaagtcgtgaatagctctgccgctttctatcaattccaaagcatctttcccgtccacccagtccggcatcataatacccgacaggctgcagatcgtaggcaaaatatctaccgattctataatttcatctctgacctcgttctccggaagccttcctttccaggaaaatatcattggtatctgtgtcacgcatctgaatccaattcctggtgctttttctatcataccatgctctccggcaaactcaccgtgatccgtcatatatataatcaatgtattttcccgtatccccagctcctccagcttattcaatactgtaccaaccgcatcatccatttgggacacacatgcataatatcctctgagtactcttttccttgccgcatcaaaatccttgtccccaaatgcaatccagtccttatccatctggaattttctctgggtatccttcgctgctgatgaacggtgttccattttatcatcatagtttggcggaagctctaattcaatcccttcatacaaatcccaaaactccttcgctgccgcataagtctgatgtggtctgggcattgtaagccaaaagcaaaacggcttttgttcctgatcagcctgttctataaacttatttgcacagtttgcagaccacatttctatggtatgttccttgggaattctggaatatctggcatccacacattgtccttttttatgttgattttcctcaaaccattcctgaagaattttgtcatctctctccccatagcagccaagcctggcgagatagtctgtatagtcatttgttacaagcccctgacacccttcttccaaatgtcggttccatggttttaaaggcacctcatatccatacccgtcagcaacgtagtcacactggtcagacacccagcctgccggagtatgtaatttgcccgctgctcccgtcatatatccctgctcttttaataatccgaacagattagggagcttctcgggcttctcccccgccaatccatagtatcctgtgttatgcgcatattgtccactaagcatgcacattctggatggtgtacaaatcggattctgtgtatatgcatgctgcataagcacaccttctcttgcaagcctgtccagattcggagttttgacctgcttattcccataacacccaagtgtacgtgctgaatgttggtcactatatagaatcagcacatttggtttctttttattttccattcccatcacctaccaccatttaattaagtcagttacctgatttctcagattaacaaattcagccgctgcaatatctctgggtcttggaagcttatcatccagaaatgtctttaccgttgtgggtttattggtaagtaccagaatttttcgtcctaaatatactgcttcctctatgttgtgtgtaatgaacatcactgttgttcccgtagcttcccacagcttaatcaattcatcttccagcttatacctcagttcaatatccagctgggcatatggttcgtccatcagaagtaagtccggctttgtcgcaaaggctcttgcgattgatactcgttgaagcatactcgccgacagctggcaaggaaagaacttcctatattctgtaagacccacaatctccatgaattcctcgactctttccattttttccttttgaggaaacttttttatatccagtccaaagcctatattttcttcgactgtgagccacggcatcgttgaattttcctgaaagatataggaaacattatgccgcttcaaatctacaggctcatcattcagcagaatcttcccttctgttatttcatacaatccggtcagactgtttaaaaaggttgtttttccgcagcctgtaggtcctaccacgcaaagcagctctcctgcttccacttcaaaattcatattatccagcactagtaaatccccaaatttctttgtaagattcactgccttaatgcttgcaccctgtcccatattttcctcctactttgtcacatccacaatgcccgtgatttcttttctgagccgtaaaaattcaggatccacatagctcctcggtctgggcaggtcgattttatactctgcttttatatgcgccgggcaattgctcatcacaacaatccggtctgcaagatacaaggcttcttcgatattattcgtgacaaaaatgactgtccgcttttctttctgccatattttttcaagctcttcctgcatcaggtatcttgtctgtgcatccaatgctccaaatggttcatccatcaataagacttcaggctcattgcaatatgcacgggcaattcccacccgctgcttcatccctccagacaatttaactggaaatgcgttctcgaaccccttcaggccaactaaatcaatataatactgagctttttctctgcgctcctgtttcttaatgcctctgattttaggtccgtactctacattccccattgttgtgagccacggaaacagggaaatggtctgatatacgacacctctgtccggaccaggggccattacttttttcccatttacaataacctcaccttcacttggcagatccagccccgagatgatatttatcatcgtagtttttccgcactgccccggaccaaacagaacaagaaattcattattttccacttccaggctgatatcatcaatgaccagatgctcctccccgtgcagattaataaaacttttattgatatggctgcaggaaattactgaatcttttacttgcctcttacattccactgacataatcttgcctccactcctctcatacatgtggccaataaaaacccgaccagaccaattgcgataatcccaacaaatatctgtggaatattattcagatccattccgctgacaatcaaaaagccaactccccttgaagaacgcaccatctctgctgccacaactgccgcccaactggttgacaggccaatctgcatgccggcaaaaatatatggaacagttgccggcagcacaaccgtccagaatacctgtgtctcgtttgctccaagcatcttggcacagcctgccagctcctggtttaaagctttcgtcccccggtaaacattgattgtcagtacattaaaagtagccaggaagataatgaagtatgtcatgctttctccgattccaaaccacaagatcgcaagagaaatccaagcaatcggcggaatagggcggatcatttcgtaaaatggattaaagatcgcctccatcagccgaaagcgtcccataagcagtccaagcgttattcccaggagacatgccaatatgtatcccacaagtaccctgctgagagaccaaaaaatatgtcccagaaccgtgtatccggcaatttcctctacaaaagagcggaaaaaggcatttaatatcactgccggacccggcatgatttttcctaatccagtcaacgacacggctgcctgccacagaagaaggaagcccaggatagaaatcgctccacagattattttctgcatgttttccggtaaacttttcgtctttttcatctaccacctgcctcctctcatcaatgccttttcaatcagacttaatattcctgcaagaacagcccctaccagtccaatcatggccatgcccgctataataatatccacacgcatcaggcctctgctctgctgaatcatgaatccaagccctcttgtcgatgccagaagctcggctgccaccagcgccccccatgatgtagcaagcgcacctttcatccccgtcatgatcataggcagagcggtcggcagcgcaatcttaaacagcatctggctgttacttgccccataagtctgtcctacccagagatgcacactttccgtctgtttgatgcccgagtatgaattaataacacaagccgtaaaggatgaaataaaaatcaccatagattttgaaaggagtccaattccaaacagtatgatcatcagaggaatccatgcaattcccggtaccgggcgtaccaaatcgaataatggtctggcaaaccagtcgaacctcttataccaggccatacatacccccaggggaattcctacaatcagaccaattacatagcctgataatgcaacctggagtgatgccagcaaatgctgccacatggtagatccatccggattaggatctgaaaattttgcaaaaaaggcctttactacacttaccggtgtcggcagcattcctgtattattaacagtagcaaaaatctgccatacgatcaggaatactgcgactgaaataattgatacaggcaaatatttattaaactttttatctctcataatgttctccctgttttcctattccattgctgccgccttcaggtcaatatcaagtactttgttcaaatattccgggtttaacgaatcatacagcttcggcacctgatcctctgtaatttttccattttccacataaaaatcacactgatctgcaaatgcctttccaaacacatagttagaatctaaaaactcttctttccccatatatgctcttactgcaatttcatcgtccatatcctcttctgtatattcacgtccatttgccgcaaaaaactccatggaatattcttttctgagtgcatcatctttcatttcttctgtggccttcatgacacatttcatgaacttctcaatatcctcagggtgtttatctatcacttccgtgcgtccgaatattgcatcatacatagaaaaacctgttgaatcttcgaaggtggcaacctcaaccattccctcactcaatgcatagaacgaatacggcgggtatgctgcaagcgcatctccctctcctgctataaaagcctgataggccggaccggcatccatatgcacaaccgtataatcatccgcttcgaggccgaactgttctgcatagcgaattacatttaactggcttgaggttccaagctgtcctaaaaatgtcttacccttcaggctttccgctgatccatacatttctgacagaccctcaatctttcctttctctttcaatatctcagaatctggtcttacataaattcccatgccacctgcaacatccaattctgccaataaggtacaatttccacttgctaatgagaaaatacttgctgcaccagaagcggctaaatcgatttgttttgctacaattgcttcatttacaggtgcccccgtctgaaagacagatatctctatgtcaagcccttcttcttcaaaataccctttgtcataggcatactgaaccggaaccccaactgtcgaaggcataatccccacccttagtttttctgatttttcttctttactgcctgaatcatttttcccctggcatccggctgccatcgttcctaccattacgaccatcagaaatacacttaccatttttttgaacatactaatcctcctcgtttttcttttcgtttctttattttttgttttttatcttgtgtttttatcttatcacaatgccttttttattcaatatgccaaaaaatctttttttcaaatcgatttgattttcttttttgacatcctattctcataatgatatagtaattgtaatattaaactatatcagacgtgaatgctcgtattccggaacaatgcacgttaccaatgaacaaatgaggtatttaatatgggaaatgttaaaatcaaagatattgccgaggctgccggagtctctccagcgactgtatcctgctgccttaccggtactagaaatgtaaaacccgagacaaaagcccgaatcatggaaacaattgaacgtttgcgctatatccccaactcttctgccagaaacctgcgttgtaattcttcgagccatgtcggtatcgttctcacaggtatggatgaatctttttatgcaaatgtgctgattggcatttcttctgccttatcttcttcagaactatcattgagagtggcattttcacataattctccggaaacagagtgcaccatcattgatgattttataagtcaaaatatctctggcctgatacttgtaacatgccagcctgagaatacggcattttttgaaagcagaattgaacattaccaaattcctgcagtttttttagacagaaccccacatagtttaaagacaaattatgtaggtttcgataacttcaaaacgatttcgtattttatggatatcctgctccggaatcattaccagaaaatcgccctcttctgcggccccacacatttcagttctgaagctgactgtattcacgcttatcagcatcatatgagtcgttttcatccccagcttaaagagcttatttttcctaccaatgcttctaaagaggatgcgtttaaaaatgcatttatcagcctcaatgaacaaaatatgcaggctattatatgctcttctgaagcaattgcgaccggtgtttcgacggccgcctctctccttggactggatacagaaaaagacctgctgattctgtcactggccggagaaaactggtgccttccggttcagtcacatggcatggtctattcctctaaatcagcttataaaatgggactccaggcaggcagacttttaatgcaggcaatgcaggatgaaagccacagtcaggctgtatcaactatcctaacggattctatcttgagtcagcttacctccgaaaccatccggcaggcgccgcctttgatacagaatccccattcccagccaaactccgtccttcggattatgcttaccgatttaaattccgctaattctattactattctctcaaaacagttcgaaagattggaaaatgttaaaatagagtatgagtttgttacacaaaaagatgtcctgaaatcaattattgccgacagcaaactgccaaggcccagatttgatatttatatgtacgatataccctggattcactatcttgcacaaaatcgcctgattgaggatataactgaatatataaagacaagccctttccacgaaggaaactttttttcacataatttaaacaattgccgggttggaaacagctatttcggtgtacccgtcgtaggcggtgcgcagatcatgttctacagaaaagacctgttcgaaaataagaccttgcagaaaagatataaagaattatacaaaacttcattgaagccaccaaaaacgtggaagcaatttcttcagacagcacgttttttcacaaaaaaatacaattccggctctccgactccatatggcacgtccctggccggaattgattccctgacattagcgccagaattatttgcaagaatactttcgtgcggcggttccgtatgggactcccactgccgggtatcattgaattcacccgagaacctccaggctttttgcattgtacaggagacaatccgttattgtgagaattctccattcgaaacttccattgctaagactgtacaggatttttgcaccggtaaaacagcaatacttattacatatattgaacgtgcaaccgaaatcacaaatgccctcacccataatatgataggttccgttgattacactaccgtccccggctatgtcccggtaagtataggctggaattttgggatcagcccttatactgagaatctggacgtaatctatcactacctgaactggctgggagaccgggatgtcaacaattatctgaccattcttgatggacagactgcccacatggagccttaccataatcctgaatttatcaggctgtatccctggatgaaatatacggaaaatagttttaaatattgccgcaaccgaatacaggtctacaagaaaaatgctatgataataccacaaaatgagattgataatctgttatatttaattttaatggatattgaaatgaatgattataccgtagaagatgccttgtacaaagctcagaccgaaggcaaagagctgttgaagaaatatggatattatccgacacctaaactgcattgattctattaccatattcctcgaagaaaggattggcagtccattcatatgcgctgctgaccataatgaatcgccggcataaagatgttgactgacctcgatggactgcctgacatatttcatcctttcagatggaggaatttgcgtaattcttatcttatctgctgtaaaggagtatggttttgtcgggtcaactttatattttaaacattcagaaaatagtaaaagtcaatttcatgcttagttatcgtcattcccggattatccaatctgcccctgacttctttaatgacttctttatatgcattccaatatgcttcttcgctgattgtcaatgaaggatttcttatgcttacaactatataaattatatcacctgattcgtgcccacttttcaattcactcacaaggtaatttgtatctatgatgcctgtgacataaatgcccgtttcctcaaaaaccttctcagcgctcacttcccaaatatcggctaaaacattaattgtatagcttctctggtcaactcccagaaaagtaactgaatagcgttctgttatcattgttttcctccatttgtttacaattagtatatgtttcatgccgaatattgtgctatagagcactcccctaatcgcctgcatcatatgtactattgttttcgatttttatactatctaactcttaatttgtaaatatataataattataaatattaatgcagataatcagaatcagtaaggctgtaaataatctgtcaacagccctgttggaaattcgactgttgagactgcgccccattatcccacccaatatgccgccgagaaccatcattaaaagcatcggtacgctgaatttaggtatactccctgttagaatagcggaaagcaggcttgtaatctgtgaatagaaaattatgtaaagggaattttctgctgccgccttcgtattcatggaaaagaaaaagtataaaacagcaagattaacgggcccgccgcctataccgagaaaagaagaaagaattcccaaaacaatacctataaatacgcatgccgcagcattggtaatatgatatgagttaagcttatttctgcaaagggtatataatagagttgctgcagtaataatcaacaggcaaatggcctgtattgctcctattttatttttatcagaactcaaagcagaaataaacccaaacatccatttccccaagattccccccgcagcagcaccgagtgcaagtggaagcccggttttgggctcaagctgtgatttaccgttgactttacttttcagaacagcatatgtgctcatggacaaaacagtacagccagataagaagctgattgtggcaacatctaaaatttgaaaagcatctaaaacaggcttaataataacaccgcctccaatgccgcagattgcaccgacaatagacgcgccgaagcagattacaaaaaatataaccagtaacatagtttctcctctctttgttttatttttatggtctgttttagtgtatagtggtttattgaagtaaaacaattgttatgttaatatagaatacatataagaaatgatataaataaaactgcaattggaagaaaggaacataatatgacattaaagcattttcagatattttcagaagtatgccgatttgggagcataacaaaagcagcagaatatatgaacatggctcagcccgctgtcagccatgctatcagggaattggaaagctactatagtgccagactctttgaacgtatgaatcgccgcatatatatcacaccggcaggtgaacaacttcttgcatatgcagattccatacttggccagttcaatgaaacaagagatgttctcagagatgcaggtcggttcacaaaagtaagaataggaacgaatgtatcatatggaacaggaatatttccaggtatggtatctgccttttcgaaagagcatccagatattcctctgttttttacagtacataattcagggaagatcgaagaatctcttttgcgaaatgaactggactttggaatcattgattatcccaataatcctttatattttcattatatgctgataagagaggaggaaatggcggcggtatgtacgccagagtttgaaattcctgatactatctctatggaagaaatagaaggtatccctctattagtaagggaaaaggggagcggttcccgcaattatgttgaacgcattctgtctgattacagtataaaaccactgattaaaatggaaagcgtaagcactcaaagcttaattgaaatttgtaaaactggaatggggatgttatttttgcccttatctttagtaaaaaggcagcttgaagacggaagccttcggaaaattaaaattatagagaataaatgggagagaaaatattatctggtttaccataagagtaagtatttgacccaaagcatgaaattattcctgcagtatgtagccggaaataaatagagctaaaagggatggtaatcacacccataaatttttaataagtaccatatgaggaatgcgctttctaagaaaacatatggaatattacccagtgaatatattcaggaatgccatctaaaaaaaacaaaaggacttctgctggctggaaaaacatcaaaggatgtcgctgaaatggtaggctttaaagagccgctgtattttccaaaagtatttaagaaaaacatggctctgcctccgtcaaaatacgtgaagctgtgggccggaaaacaaagtctttaaaaacgaagtgtttcattttctccatattgaagttttcatatttccatttcaaaatatagatctcagagatataatatcaatatcaaaaaatgcaagaaagggaaagacatatgaataaacaagaatatttagaagagattgaaaaggtaattgaaaatggtccatataaagcaacctgggaatcgctttgcggacatgaaacgccaaaatggtaccggcaggataaatttggaatttttatccattggggaatatacagcgtccctgcttttggaaatgaatggtatgcgcattatgtatataaacaggggagccctgaatttcaatatcataaggacaactacggggatttaaaagccttcggatataaagactttattcccatgtttacagcagaaaagttctgtgcagagcagtgggcggaactctttaaagaagctggcgccaggtttgttatgccggtcgcggaacaccatgatggatttcagatgtacgagagtgaactaagcgactggaatgcaaagaaaatgggaccagggagagatgtactgggagaactgaaaacagcagtggaaaaacgggatatgaagatatgcgcatcttctcaccgcgccgagcactggtggttttttaacagaggacgggattttgactgtgatgtgcaggatcaggcatatcaggcgttctacgggcctgcctgcggtccaagccataactggaataccttgtacgataatgcccctgatgaggagtttctggaagactggttggttagaagctgtgagatcgtagataaatacaggcctaagattatgtttttcgactggtggatacaggtatatgcgtttaaaagatatttgcagaagtttgctgcctattattataacagggcggcatcatggggaactgatgtggcaatagatgctaagtttgacgcttatgtacatggcagtgccgtaaaagatatcgaaaggggacagctgaatcacatcagtcctgatttctggcagaatgatacctctgtagccaaaaattcctggggatatacgaagaataatgattataaggattctgtagaaattattcaggatttggttgatgtagtaagtaagaatggggcgcttcttttaaacattggtccaaaggcagatggaacaatccctaaggaagatgaaaatatattaagagaaatcggaaactggctgaagattaatggagaagctatttacaacaccgtttattggaaaacttttggggagggtccgacggaagttcctgaaggacactttacggaaacacagcggaaggagtacacacctcaggatatcagatttacggccagagcaaattacatttatgcaacagtcatgaaatggcctgtgtctggtactgtgaagattaaatcattgggaacaggcagcggctatttcaaatcctctattaaggatattgagattctggaaacaggagagcatccttattacgaattaaggcaggatcttgaaatatataccaccctatacgaaagcagccggccggtctgtttgaaaataacgatagactagaatcaatggtaaatgggcataaatcaggactgtgcatacgctgcacagtccgtgttaaagacttataatattctcccataactcccccccaattccattccagcttggataatgccaatctttccattaagatatcgttcaacaatttttactttttctaccggatctatcttactttttctagacatagaaatacccccatataggactttaatatctcattgtactatatgggggtagcatatcatatcattcccaacagcccctttatggctcctactacatttggttggctttattcatcaaaatcttttcctgtaacttccctataaaacgttctattaatatctataccaagacctggcaatgttggctttgcaaggtaaccatctacaataggctcttcatttgttgtaagattctttctcaacgcacctgcataaaaatcaggatgcaggtattctacatactttgtatacttattgctgatatggaaatgacgacaagcagccgctgttatacctgttttccactgatgagggctgacttgtacgttatactgctctgccatatgagcaatcctacgtaattcggtcaaaccaccacacctattataatcaggctggatgatagaaacaccactatattttagccagatctctgcttcaaaacgagaggttcccatttccattccacaaattcgtgttttaacagattcagatagctttctatgcccctcaatatcatcatgcggaagggctgcctctataaaataaatatcaatatcttctaatttattcagaatccactttacttcttcccaatcgctccaacggtaaagtggatcaacagccatatcaatctcatcgccaagcatttttctgcactcacgcaggtagaaaaccacttgttcttttgtcatgatcgcatcctgcataagacaaactttcacggccttcacatttttttcttttgctttttccaacaaaggtttgtaggctgccaaagcagttttgggttctgcatcagaaggacaatccggataaagtgtaaaatatggtgttactttatcgcgaaattccccacccattaatttatataccgggacattatactgttttccgaccaaatcataaagagccatatctatacccgaaattgcaaacattccaaaaccacgcatacctatccaacgtgttgtttcatacatacaatcccagttggcatcaaactctattggatcccgtccgatcagaacgtctgtaagcctggataaccatttatgttctgtgtctgcatttgcaaaagcagcgataacatctggtgaaccatcagcttcaccaataccataacgtcctttttcatcagtcacttttacaatacatgtattttggctccagttatttgcagcaatatttacaggcaaaaattctatttgtttaataagttttccattcataatctgtttctacctttctattatttttttcacattatttatcagcttcttttgtttctatttcttctactgctatatgctccattatattggaactaaccgtatagtcctttttcaaccatcgaataaggcaaataaacataataacataaagaataatcataggaggcgcagatatgattgccatcgacttaattgtgttaattgcaccgcccatcagtaaagcaaccatgctgatggctcctactgcaatgcaccatgtaatacgtatagccaaagcggggtcaccatctttttcaagctttttagtcgtcattaaagacactgcatatgttgcagatgacattgttgtagtaattaaaaaatataccgatataagaaatattatcaaaagaatactgccgcctggaacagaagaaattacctcaatcactgccgcagataatcccttttcatgaaaccattcaataatcggaagactccctgtcaaaataccatctactgtatacccccctaaaacccccataaagagcatgcaccccagtgagctgcctacaacacaggtaagaataacttgtcttattgtgcgtcctttggatacttttgcaatgaacaatcccatcataacaagatatgcaaaataccatgcccaataaaatattgtccagtcctgtggaaaatttgtcttatgaacagggtctgtataaaacgacattctaaaaaagttatccagaatcataccagtgctgtcacaaatataatttattatgaaggaagttggtccaacaacaagaataaaaataatcattgcaacagaaacataaacacaaatatcagctagcttggagatacccttttttaatccaagcgtcataacaacaatatagaatataataaacgaagcaacaatcgtaaccttgacacctgtggtaggaacaatgccaaataccttttgaagacctgcacctaacgacaccttataaaaagattctgccgctaatatcctatccgaaaaatctttatggcagatagtattttctccgtaatagtcccaaaacttcttttcattcacatttgccaatttaaaaatgaaacttggattctggacaattccatcattaccaaagcgaaacattccgccagatgctgcgacaagaacagcatcaccagacgcgtcgatataattctttgcacatatacgtccatatccatttgcagtcaaaacatatacttctgtcaactttttgttttccatgacagcatcgcatataacagtatgatacatgatttttactcccacagcacaaagcatattttccgcgacaattttccagataaacggctcatgggcatccacgtatgtatttccatatagctggggttttgttaaccccccatattttttcatttcacatcgaaatctctcggcgaaaccatatactatctgccgaggcccctttttaacctgccaatcttcgtttgtcaaatatagaccacatattgttgcagataggccgccaactgcttgtccccctagaaatccgtttttttcaactaacagtactcgaaggccaaatcgtgcagccgtttcggctgtcgccactcctgctggccccccacctataacgaccacatctgcttctgccagtaaaggtgcatttttaaataaataatattttttttcctcccgcatagacatcactctcccttatactttttattatccatattaattgttgctatgtatttctgtaatatattatactgatatattacagaaacatcaatatacatatttaatataaatcatctagttgttttatgatatattaacaaaagaacgaaatattttactagaatttttcaattgatgcaattgatacgtataaaaaaattgatttaatatatcttgaaaaataaaataaaaaacgatatactatatatattctgactgatgtgtgcgcttacgtatattgtggtatttagccagagccactatccttattttgcttttgaaagtatctctgaataaagggaattctaggcatccttccattacagtgattctcttaactcgcgctactggttctgaatcgtggtgcacatagtcccaatcctgggacaggtattttaaaaaacacaaacttatgcggagtttcctttgtggctgggtacatacactaataaatagttaagtttatgagaaccagctattatgtttagcaaactgatagttttttaatcataacccataaaaaattaaagatgaaggtgtattatgcaaacggaaagttatttttcaaaaaaagccaaaaatactttggtagataccgcttataaaagattagaagaaatgattgtaactgccgaattaagacctgatacaataataacagaaactgagttaagcaattatcttaatatcggtcgcactcctattcgcgaagcattaaaaaaaattgctcttactcgtgcaattgcctttttacccagaaaagggattttaatacgtgttataccgatagatgaacttctccaacaaattgaagttcgttctgtgttagaggacttagccataaaatctgctgttatgtatgcaaatgctaaagaacgcgaggacttgcgttctttagcaaaagaataccgacgtttgaccgaagaatggaaaccagcactagaagctttgtatatagatgatgaatttaaccatttactttgcaaatgttcaagaaatccttatataactgatacccttttgcctttatatacacttgcacgacgcaattactatttaaattattttattgacaaagagttgacgtatcttgtaaattttcagcattcggcccttatggatgcaatagcagacggagatttaaaattagcacttgaatgtaatgaaaaacttatgcaaagtgtcgttaaattcagcagtcttagtttacgtctatggctccctgatattgatgatcaagaaaaatgctaatttaatcacgcctctgtcatactaacagaataagaaatcccccagcacttaccgggggaatgtctgtcttttaacttttaagtttgcttcggcaatcatcaggcaggttggaggttcatggaagaatatccaccatctcttcctttgccggaaacacactgagttctagccaagagcataaaacactcaggacattctataaataatggatttacaatgctttttgatacaataaaatcatatctttttccattgtctgtcgcggattcacctgaacatttgcacttttcattgcatcttctgccatttgcgggattttatcttcagtaacaccgatttctgacagagaactcgggagaccaagttctgcatttagcttttttactgcttccacaagcatttccggcttgaaatcgatttgcggatctttacctgtgatataaccataaattttcgcatagcggccatgatccgccaacgcattgtattctatgactgaaggcagaattactgcatttgccacaccatggggaacatggaaataagtactgaccggatggctcatggcatgaacatttccaagttttgcccacgcgaatgcgattcctgcaaaattacagcctgccatcatagcacatgcagcatcttcatcctttcggttggcaacaaaacgacgaatatttccgccgatcagctccattgctttctcagccattgcatctgagaaaggtgttgccatcacagacacataagcctccatcgcgtgaatcaatgcatcaattccacaagatgctgcgatagatgccggtgctgtcataatcaattctggatcaagtactgcatatttcggaatgatttcatagctgataatggacagtttatagtttctctcttcatctgtaattacggcagatgctgttacttcacttccagttcctgcagtcgttggaatcacaatcataggtacaatcgttcccggaactttacagagaccttcatagtctgtgatattacctccataattcgccagcactcctactgccttcgccacatccattgggcttccaccgcctagtgccacaagacttgtcgcaccacatttatgataaaacgctgtcgcttcattgacaatattaatcgtaggattaggaatgacttccagatactttgtacacttgatgccactggcttcgataatattctgaatcctatctacaacaccaattctttccagtccatgatctgatataagaaacacatgttccgagccgacttcttttaaaatctccggaagtttattcaaactgcctgctccaaattctatattctgcggtattttaaaactaaactctttcattttatttattgctcctatgtgtattttacgattagtcaatttgcggcgccagtgtttttaatcttccatcggtgtgtatattgtactcatcgatgcactccacgatctttccaagtgttggacatactgtaacacctgcatcttccaatgccgctacttttgattttacagttcccataccgccgcttacaattgcaccggcatgccccatgcgcttattctccggagcgtacattcctgcgatataagcatataccggctttttcatccccagctctttgatcttagccgctgccatctcttcacttgttccgcctatttctccgattatcacaatcgcatcggtttcgtcatctttggcaaacagttccaatatgtctgcgtgattcatgccgattattgaatctccaccgattcccacacaggtagaaagtccgaaccccttaaaagtaaggtttgaagccgtctcatgtgtcagtgttccgcttcgggaaatgataccaatatgccctttcccataaatataatccggcataattcccaacttagatttccccggtgaaatgatacctattgtattcggtccaacaacttttgcacccagtattttggcttcattgacaatctctaacacatccagaaccggaacgaattctgtgataattaccagtagcttgattccttcatgtagtgccctcatagcggcatctttaacgaattttggaggtacaagtagcattgcggattcaattcccggaaatttaatttttgcgtctgcaacagtttcaaatacaggtacgccctctactttctgtccgccctttcccggtgcaacaccggcaaggagttttgcaccactttccaatgtacgcatgcagtgagtacggccctgttttcctgtgataccaataatcataagttcagtatcctgattgattaatatactcatattattgcacctcctttatcctcattaatgtttgcactgcttcatcagttgttccatattttgtctgtagaaaaccaaggttttcgtaaatagtccacccctgttcctgattaaatccgcggctcttaaccacaactgttttctggattcccaattctttgtatgctcgggcaattccttctgccatatctgcacagttattgataccgccaaatacattgacaagaatataattcgtagatttattctgaagcaaaattttcattgcatgataggttttctctgccgttacaccgccgcctagatcaaggaaattattaacacatccgccataatgacggatagtatccattgttgccattccgattccagcacctcccgccattgtcccaatgtctccttctggattcagttccacataagtcagatcatgtgcttttgcatcttcttcctgaggtgacttcttctgcgcagtacgcggaaggattgtgtaatcaccttgacgcacaaggctattatcatctattaccaattttgaatcaagtgccaacatgcttccgtcctcaaggacagctaacggattaatctccattgtagtcgcatccagctcaaagcaggcacggcaaagcttttctgcaatatccgccaccttattcagacgttcctttggcaaatcaaagactgacgcttcaccaagaaagacctctctgtcaaaccctgccgtacagttaaatctcaataatttttctggtgcgtttaccgccagttcctcgatttccattccaccgtaaggagtaaagagcataaccataacacgttcctttacatccagtgtcattcccagataatattcatctgcaattggaagaaaaccgcatgcagccaccccttccatatgtttgccattgattgtgatttcttcaatcaccttctttacttcccggaattcttcttctgattttacaacacgaactgcacctgcttttcctctttttcctgaaagaatctgtcctttcagcacacaaggatatgtcacttcttccggaatattatcaccattcaaaaggatactatcatttaccggaattccaaaacgctttaactgtgcttttccttcgatttctaaataatccatacatgcactccctttctgttcaagactcatttacgaactttttcccatctaatgccacagcgccattttcatggcgctgtgcaggatatttcaccgtatttatgattcccacgcgatttccagattcggcagataagactcctcaaacggatatcccacgtaggtagtattcatcagatgttcataattaaagtttccgctgaagctgttatttccccaagaaccgcatcctaatgttgtggtcggtacaaatccgtttgtcggacttcctcccccggtagtccctgccggctgatttacgatcacacgagatacagagcattcaattgctgcatactctatatgctccgctgtatttgaatggatagaaatactgtgcccttttccttcgtattccagattttctaccatcattgcaacaccctctgcaaaagttccgtacggatatacggtaaggactggacagagtttttcacggcagagatcatcggcatgtccgatagcttgtgctttcactacaattgcacgggttcttttcggtacatccacccccagcatttttccaacctgtgctgcagtcaatcctactacatcacggctgatcggacctccttccggaaatagaccttctcttattttcgctacctgccttggatcatctacataatagccaccgtgattctgcatttcttttgcaaacacatcaaatttctcttccggagcaaatgcagtctgttcacccaaacagattaatccattgtcaaagctgcgccctgctaagatcttttctgctgcctcactcaaatccacatcacggtctacgatacactggacgtttccctgacctacgccaagagacggctttccactggaatatgcagctttcaccatacccggtccgcctgtagctacaacaacatctgccctgctcatcaaggcaccactgtcatcaatagatacctgttccaatcccaacacaagatcctttggaagtccgatttttcccaattctgtctggaacatatctaccagaagttttgtacatttcacagctctgggatgtggggcaaaaataatagaattccttgttttcagtgcagacgctgcatttcccattggagtaacaacgggatttgtagacggaatgattgctgcaacaacacccaccggttttgctattagcagcattttgcgttcttcaattcgattgataataccaactgtcttctttccctttaagctctgccaaatcagtgcggatttattacggcattttgcaatcttgtctgtcacatttcccatgcgagattcttctgccgccattttcccaagcatttccgcattgtcataaacgactttacagattgcgcgggctgctgtatcagcctgctcctgtgtcgcaaattcaaattgtttctgagctgtcttagaacgcgtaactaattcttctacggtcattttattcactcctttatttaaattttcctataaattcttaccgttaaaaccatgcataaagaattacagaattttaaagcaaaccagtcaatttccacattggatatataacaataacaaatcctaaatacatgataatcgttcgcaaggtcatctgcttgataaattctttcattggtatcatcccatactgatacataatcaaatagcctgatgattcatatggaaagaaaaccatttcacttgaataaatcaataacataacagcagctaccgggtttatccccaaagaaactgcaatgtgagcaaatggaatagccaatccccccaacattgcaaacggtgtcataaacaaatttgcaatcatccccattgcaagcagcaccaaacatacaaacagcattccctttccttccaaaatcggcaaggcaatagttgtcagaagatcatcaaaaccaattgcagatcccacaatcccaattcccatacatgtggccacaaaaaataccgttgaaaaatttaacctttttatggtatcttcatttcccaaccgtatgcccggcataaacatcaacaacgggaggataataaatccgtatgactctggtagtccgataaaacgagaacaattcaaatatatcagcagtatgaccaacatcacaacggcttttttttccttcttgctcatcgttcccagtgttgcatagcgtttttcaaaacactctttatagctactgtaccccttcatcttataatccttaaccttgtacaccttcattacaatgataaacaccagcatacaccacaataaaaaccaaccattatactgaaatgcagatttcaaagtcatcctataccctggtgcaaattctgtcagtgcactttctaccatagaaaaatacactggattatataagcagatttcactccctgatgctcccataattcctgcaagacagacgatggccgattctttagagcactttaactccatatttttacagataccataaataagaacactaccaatcagccacccattacaaaacgttaccagattcaaaataattccaataataaaactgccaaatacaacacccttaaaggttctgccacatttttttataacaaaacaggaaattctttttagcagaccgcaatcttccaacatattgctaagaagcagccccccaatgaccatccataccgtcctgctggtccatgatgcaaaggctgtttccactggtacaagctccgttaccatatataagcatggcaaaagaactgcggcaattacattgggtaacaattcaaaggcaaagataaaaataacaaaaaatgtaataacaaaaaagagctttagtgaacctgaaaatatatcagaaactggaatacatgcgataaacgctggaattgaaatactaattccccatccaatcatcgtttttctgtccgccttattctccaaggtttcctctcctttttccgttgtgtttccacagatattttataatagcttttcccataactccatcatattcttttatatccacaggatgctatattatcaaaacagagccaataaactagtcacaaacatgcttccaccagtacccaacagaactacataaataaaacgcaaaaattgagcacggttaactttatgtaacaatttaataccaaaataataccccaaaattgtaaacggaactgcacaaacaaaataccctagaacttccggtgtccatctaccggtaacgcaatgacgcactgcattaatcgtgtccagaatgcaccacattgtcagcatcgtgctacgaaacctatacttatccttaactgcatttaaggtataaacagtaatcaaaggaccgccaattgtaaatgcgccatgcacagtagctccaataattaggcaagtataacgaaatactttttttcctaatgtatcagattcatcatcctcttcttcctccggaattttgaaaacataaggtttaataatgtgtttccaaatattcattaaagcgataatcgtaacagctcccccaataccaattttagccatatcagcgttaataataattcccaaataatttccaagaatgaatcccggcgccatgaacaaaaggattttacctaaatctttccaggatgttgttttaaatccggtaattgctgaataatacaaaactggcaatgccaacatagttgcaaagggaatacttgtatctggtcctatcaaagccgcattaataggagaagatataactgaaccaccgaaaccggcacaaccttcaacgaagtaaccaaatgactgcaacatgcctataaataacatcttcaattcaaaaatcataacaaagacccctctcattttaattctagattatttcagtaagtgaccaacttttagcctttttcacagaccgaaataatctagtatactaatcatggtaaatcattataatatttcatataatgttaagcaccttatttgagattaaaagtgatactctgtacgtccaatgatatcattctgcagacgcctgcctaattcaacaaaatatgcagaatatcctgcaactcgcaccaacatatccttgtaatcctgcggattcttctgtgcagctttcattttctcggcagacataacattgaactggacatgaagaatctttctgtcaattaactcggaaatgaaacctgccagattgtcacgcccttctgttcctgcaactgcatcctcagggaaacgaatatttaaaagtgttccatttgttgcaaaaccatgatctactttagctacagaatttataattgctgttggccccttaacatcgtgagatgcacattcggtatgaacagggcacatattttcggaaattggttcccagttcttccgcccgtcaatactcgcaactgtttggtgacccatactaacatttgcattaacagagtaaacacccggattaaattttccacctcttggatgattcttattctttttcatatttgtgcagatgctattaaatacaaacttaaagaggtcatctgcatagtcatcatcgttaccaaaatgatgaaccttcgaactatttaccagttgatatagtttttcatgaccttcccaattatccagacatgcctgaaccagttcttctatcgaatagctcttttcatcaaataccaattgcttaattgttgataaaatatctgctgctgtcgcacaacctgatgtctccggtccagttccattatactgtgcaccaccttctgtcagatccaggccgttgtcaagcggatcgttaaacagggtcgaaataaacggtaatggcttacgttttctatgtgatacatccaaaacattattacattcacatatcattcttgttgcatattcaaattccttatccactgcccccaaaacttcttcaaagctctcgaacgtatcgtaaccgcctgcatcaggtccgatctgctcactctctccaaacaaacgtccatgatttagtgccatttccataaccttaactgcattaatcatacctgcgccgacccatccatattctcttccgtcaagagtaggctcaacgcaaccaacaacagaataatttctagcttcctctaatgttgcccccttttccagatacgctttaatcgcaggagcatcattataaagttttggatgtccaaaaccgcaccgtataacttcaactgtcttaatcagaagctcatacggtgttttatctgaaaagcgaactgccgtccatggcgccagcatacgtgtatgcgcacttgcttccagaaccatcattgttgtatcatttgttgcatcctctccatccggtccaataccgccaattgtcagcgattcgcctccaaatccacggccattacgttctgcaacagtatctgcatctttcaactttgtcggattgttcagcttaacaaactgaacttccaacagttccaaggcaaattcttttgtaatcataccttgttttaaatcatgctgaagatatggatctaaccactggtcaaaacgcccataagagattgactgtccattcgcttccatttcgattaatgtagtcaataaattaaacaactgcaatgcctgccaatatgtctttgcgggtcctcctgcaatttgttctaagtttgcagacatttgttcaagttcactctttctctgagggtctgtttcctttgctgcatactcagcagcagtctctgcaaaacgctttgtatatgcttttgcagccctcagagtaatcagcattgcctcgtactgttccatcttctcttcataatccggggcccccggatgtaaatgagcacgtgcattctcccccttctcaatcaagccgtcaaaccctagcttcagagctcttccataattaacagctgtatgtccaatacctccaaaacgataatccgaactaataccaatacttgcaccacactcattactttttttcatttcttctgtataggactcttccactaatgcgttgacagtcttaccaatccaccattcgcatagttcaagaatttcctgccggtcttcatcactcttgatgtaaaattcatcatttggacgttcctcaaaaggatggtttttaatctcatcaatgatccatttaacagaatattccgggaacagcggtgcttcttttgccggcgccgcaatctcaccgacaatcagttcatccggataaatcacaagaggaatatttgctgtcaaatgctcgaatgcatgagccgtttgcatcttccatgattctccccagtgctctttgtaagactcagttaccaaacgcaaacgtgttacgtcaatattccatggcaattctccccatttttcgcgcaaccgatttacacgtgggaacggtgaccatccctcatgtcctacctggtatccaatccccccatactggtggtcatacggataaaccccgcttgcagtagtgtgattcattttcttcatagttatatcctcctttaaaatttttttacatcagattggcatcagaagatctattttcctccacttctctggttcctacaacacaatgaatgcctctcccattaaagtaatctgcatatttctgaattcttttctgcaatgctggacgattcattcgatacccacgcattggataaggcctgtttaaagactcatacttttcctcacccaatctcatataacttaataactgtaatgtcctaactttatttttcatttctttaatgataaaatcagccgtttcctccatattcttcatatcatcattaaatcgaggaataacaggtattcttaagataataggttttccctgctctgccagcttctttaaacaatttaaaattttcgtattagacacaccagttctagtcttatgaacctcaccattcatatgtttaatatctgcaatgaataaatccgtacagggtaaaactttctctacgctttcccactctccataaaaatcagattcaagacaagtatgatacccctccctctgacactgctcaaacaatgcagccacaaaatcaacctgtaccaatggatcaccaccagaaacagtaacgcccccgcctgaacgctcatagtatcctttatccttacgaatttctttcatgcagtcctcgatagtcataacctctccccactgttttaaagcatcactggggcattccttaacacaagccagacaacctatacactttttatagtcaatggataccagtttcccttgttcattaaaattcagcatctcagggtttgggcatacttccaaacagccaccgcacttcttatctgtaatacatctttttgtataaaccccaacttcaatcttaactttctgactttctgggttactgcaccactcacaacgaagaggacatcctttcagaaaaaattctgtacgcaaaccaggaccatcatgaatggtatagcgctgtacattgaatacaatccctttgttattcatttcatctccttttacaccataccggtataccggtttatctttgtaaatccagtatatgcctgatccggtataccggtcaactcatttttttattttctatgttttgcataattgattcacataaatttgtatacttttcacaacacatagactttcaacagttgataacaatataattacttacaaaattttgtacatcaaaatatagaaaggaaatcacattgggaaggcaattaagagaagagcgtttactgtgagctaatagcagaatgcgcatttcggcgctatttagtaatatatggagttgaaatttaaaataaaatatcgtaaaatgaattaaataatcataaaataaaaaactatattgaatttaaaacattaaatttgggaagacatattttgaacagaggagttttaataaatgacatcattaaaccaacatgcctacaatcatctcaagaaacttattaccactcaacagctttcagctgataagatctattcagaaacaaagctggcaaactctcttggcatttccaggacgccttttcatcatgcaatgctccgtcttgtacaagaaggttatatcgatattttgccaagcaaaggattttgtattcatcagctaacaaaccaagagataattgaaacaatccaaactcgactagcacttgaagcttacagtgctacaataatcacaagtcattatactcaacctaaggcaaaagaactttttaagatattacaccaaaaaacagatttcatgttaagcatatataatacaacacagtcggttgccgaatttcttgaccatgatttttcatttcacttagagataataaaatatattgaaaatgaagaatttattttactatttaataaatatttatatcgtatgcttaagttagcaacactttcttttgctcgtccaggaagaatgttacaagcatacaaagaacatatttcaattttggaaaccatggaaaaaggtgatattgagcatatttatgctattacattaaaacataaaaatataccagacaagattaacccagaaaaaaatgacatcttattgtaatttttgttcctacacttgtctcagtgctgcttgcatttcataagtgtggatcacatacttccgcacgctgactatagtaagcacgcactgagacaagattttaagcgaatttatcctcacaatattagcccacacttctacaattaaatgttgcacttagtaggtacatactccaatccctgctataccgatatcactaagcaaataactcgctttactacactcatcctcataatttccctccacagtatatatcatcccatcttctactttttccacgatccccacatgttccgatatcctgtccccatcaaaatcaaaaaatataatatcaccagatataggaacataatcccgtcctttccagcgcccatgttcttgaaaccatgcagctccatttgggcaatatgcaaatttcggaaccaatccactttctatatatccgcactgctctgcacaccaagacacaaagcaggcacaccattcttctcttccgctgaatccgtaccatctccaataaggctctccccctatatttccgacctgagacaatgcaacttccactatcgccttgctaccgccaccttgtaccacttccctaaaagcataataacgaagtacatgggaggtatattctttgtctccatagctgctccatcccatcctctgcgccatcatatctgaatattgtgccgcatttgcagcagtatactttccatccttttctactgcccagttaatatacgcatttccaaatagcgataggtaatcctttgaaatcatctccggattttcccccgctctacaccgtgcatgagactttcacctcacacggcgtgccatctataaccaatgtatcttattcttttattggtttgccagctgatacaaatccatacataactttgctttatccgccgatagttgatgcttttccattaaatgattaagttcttcctgattaccattatgaattgccttatgaaataccgtgagcataatgattagattgccatatttatcagttccccctgcttttagcggggtcttgtgatggcattcccaatcatgcaatcccaattcaattcctgtaattgcacatttcccatactgcgatatgaatttcgagatacgattatcgttgtattctatcgaacgatattcagtataagacctttgtacatgacgtaaaacttcttggtctatcgcttttaaattatcgtgtatcaacgcccttcccacacttgtatatgggcagattgtttgattgaattgaatcgcatatttgtgtctccacgcataaataggaatgataatcatatcgtgtgctttataccattttggatgatatctaccatagcgtttatataaagttttggataaatctgatttctgtgctggtttccaatctcttcttagcctgttgtataacgaaatcgtaaggtgttgacttaaatgagccaaatctctgtttacatgtgttgcgacctcataataattatgaatccccataatcactgtattgtatcgccacacggattctcttgattgctctttagcaacgtttttaatagcttgtttgattttctcatgagcttttttgattgccttatcactcatgtgactataggcaacatagccctttctcttgggtctgacatacatcgtaaaacccagaaattcgcttttctcatttcttaaattgacgacccgggatttttccgggctgatttctaactttaatcgtgtttgaacaaaatcttgtgttgcatggaacattttcagagcacttgggtaatcccggcaaaagattttaaaatcatctgcgtaacgtaccagatagcaatgtttcaatttctgcttatggtaacgtaatgcctttactgctcctttttgagtagcatactttcttctagttttaaaagtttcccattgattacttacccaccaatccaattcatttaaaacgatattggctaaaagaggacttaatatccctccctgcggtgttccttttgacgaaacaccttctccaacaatctccgcttttagcagtgcagaaataatagaaagtaatttcttctcacggattcctaatgaccaaatctgcttcaacaatttcccatgactgacattatcgaaaaatcctttaatatctacatcaacacaatagtggtatccgtttcctctattattcataaaatgatttgctcttgcgaatgcattatgagcacttctatttggacggaaaccatagctatgaggatgaaatttggcttcacaaactggttctaatatctggagaatacattgctgaaaaagcctgtcccaaatatcgggaatccccagggggcgttttttaccatccggtttaggaataaaaactcgtcggattttccctggttcataccattcaaacatttttctgatttcaataattacttcatcaatcgtcaatttttcaatatccgctattgtcttgccatcaacaccggcagtatgactgcccatgtttttcttaatgtttcgataggctaatcgaatattttcttctcttaccataagctttgtcagcttatagaagttgtttccattcttgctttgtatatatagctggtctaaagtagcctgcatatcataatactccgcatgtcttagtttattggtctttttaataagttggctcctccttactgaggtttgccatttttagtctcaccagaaccttatttactcaacttactaagatgaatgaatgatacatctttatatagactagtggctgtccctccacgttcattacacgcttcatcggtaccatgccaccgctttcactgtcataaatgagagttatatctatgctaatctcacacaaattttcctgctcaaacacttctccgaagatattttctccatgttgacagtttccaacgttccattacctttatctttacatatacttttaggactctcctttgagcctatcagcttgataccgcctgtaacggtatacggattttcataacaactaatcttactcatccgtactgataccacgcacgtggcatgcacatttctatgcactagggttatagacccgtacattcggagattcgtcaggttcatctcgccaatagttttgtgaacccattctatccatgagtattttatagactcccggcctatagacgacaccgcccacctctgggcagctttcgtagcacttggctgtgctttacggtcattctcggccgacttcaccgggctccacacggttcttgctaatatctgcttttcccgcatgccggagtattagaggaaacccttcatggcgttacccactcatttgatttctcaaagtaacagttctgaacagcttttgctgtccgcccgaccttttcagtcaggaacgtttcgcacaattatatccctgtaaagccagtttgattcgtgttatatctatcggattcttcacatcagccatctgaatactatctcgcagcatctgcactccgcattcaatagaatatgcgggatcaataattccatttggtgtacgaggatatcggttattatagccacattctgaactctgcattggatcttgcccacgccctccactttcctgcatcataaccgctttaatcagttccgtataatcttcaattccatattgtgaggcataacgccaaatagtcgattcatactgacgaacctcaacgctgatcaaatcatctgcattcccattgtttcctccactcacagacaaaacactcccaaagagaacaaccatcagaatcagtaccactgctgcactcccaaacgttgaaactaataaaaatatgctcctggtggtggaagccatcctcttagcaatctttggaacaccacggatcagtcttttagttacagaaattgaactccccatcttacgagaattctttactgttttatccatatctttagctgctctcaatacattctgtccacttgctctagcagatgtctgtgcaattttcctctcctgctgatatggtttttgaactggatataccacttgttttatatctttacccgcagaataactaaactgttttacctcctgttgcgaacgccttaaagtcttgatttctttctctattttttctttctgtttaatttcaaaattcttgatttgcgactgcatatcccggcctgttaacatatcgtcttgtctgtctggcgtcccattttctgctccaaatgtctgttcattagttgaataatgcgcctcatgcttacggcttgagaatccccttcgtattttcgagacccgttgtacagttttttcgctttgagcccaaatctgttttccagtaaagtcagccactttcttagtccctgcactgaacttctctcccgcatatgttgatgggcatgttcgatcttcgtcctgggcctcactgacatccatcttagtttttactacagaatctttcagatgtcccgaaacaatctcagccttattcaatagcttaatatctttcctactttctttctctttcacatctctccccatcagttctgcctcctcctttaccgtgctgacaacaaatttatctataccataccttctcctgccctcttttaggctccgttctgaattgctccggatgcctcagttttacgccttccatgtagtacagtgcaaaacggctgttaaacaattcataaggccccagcatctcttcccgcccctcctgcataaacccattccacaaattgaaggcaagacatgttatctccgtactctctcccgtctgccatcctgcatggattgcttccggcttaatactgtcatcttcaaagtcaaataacttaccaacgttatcacgggttatttccgtaattccaacgcaataaaaaaaggcacagtggtatttgtctttccttccactctgcctcagcattcggttataaaattcttcatgtttcttcgacgcaaaatacaaacctttcatatttatccctctaatttctatccattttcgcttcaagctgctaactttccaaattcggtacataaagatatggcgcccggcgtttatgccagatgcctaatccacttactgtttgacaataatagtcattccttattctgctgctatgctgctgaatcgcccactgggcatatgtttcggtgtgtcctttgggtatactccctggacgcataaaagcgcatgaaactgttacgtctcatgcgcctcaatatttttaactactataaactttctcggtttaacattctctcgatttctaaaagactcctgttaaattcagattcttatccactttctccaaaaccgaatatttttcttcagtataacctttagcaataaccgcatatactttttgaaccggacttgcagttacatcccttatatcctttttcaaaagagtattcggcacattcagcctcgtattccaatcttttacaaagccaatacaagcacatatgcttcccgcagctttttccgaatacagttttggccccctgtctgtaaaatctccaatcattgtaacattccgtttaatctgcatcatactttccaatatctccagtttttgtcctgtagaaccatctcttgaaaaggaaaaatcatcttcattcaaacgtctgttcaaacacttctcataaaaatgtatagcagaagctaccagagaagtatttatctttacacctgtcaaatgcagaaaattataccgatgaaacgccacttcatagcctttaatcgcagatatccttttttcttctgtctgaaactgttttttaatctgagaggggttccgtagagaaaaagaatcttctgatcttcgagatttttctgatataagtctgccgcttttgtcataatctggattgcttttcttttgtccatagccttatcctttagccatatagtttcataaaagggaatgtcgatgccgcagcaccaaacattcccttctcagggttgatttttccgttgtctgccaacctccagcacctacgtctggataataacaggtttttccgttgcctgccaacctccgacacctgcgttcggaaaacgtatcagattttaggtgtcaacccaccgctgattcacagcttttctaattacattttacaatacccttccgcaaaatgcaattacaattttattttatgccaatataatgatgttcattcaaaaaatctctgttcaacactttctatttaaaattcctccgatggcttggtggtcatcaaccgatacaattccgtatccttaggaaatggattcagaaacggcaccagggaactccccacttttgccagcccattccccgccctggcgttcgtaacataattcagctgttcctgtgagatatgcagcagttccgccagcctgtccctgtcagaagccgcctggttcagcatcaatataaattcagaattagaaagcatcgtgcgcgcctttgtagaatccagaacatattccacattctgtgtcagacttgtcacccatgcatttctttttcggaaccgccgatatgcactatcaaaaaagttttcactgtaccgatgttccaaaagtgtatgaaattcatctaaaaagatatgtgttcgaattccattctcccagtttgtcgccacccggttaatcatatggtcggtaatgaccagctgtcccacagcctttaagtcctctgtcatatcccgtgtattaaagcaaataatccggttgctgatatctacatttgacggatgtgcaaagatatccaatgttccgtccgtaaacagttccagcattaatgccagttcctgcgcttccggttccgtctgctccagcaatatccgtctcagttgaaagaaacttggaacaatcccactcttttttccgtcctgataaactcttgcaacacaccgatccagaatactcttttctttgggcccgatagcttgatgatcactgatccgctcaaaaagagacagaataaactgagacttgtcaatgatcggatccttctccccataccccttcaccatatccatcgcattgagatgtacctgcccgcccgcagaaaaggtcagcacaattccatacaatgcctcaactaaaagctgatactcgccttctggatcgtagattaggatatgatcatcggtagacaaagcaatcaaaacaatcagcagcttagtgagcatagacttcccacttcccggaactcccaggacaaatgccgaaggattcagaagattatccctatttaccagtatcagattatgagaaattgcattcacccccatataaataccaccggcatccagaacctcctgcgcccggaatggcatcaatacagccagactttccgttgtcagcgtccgaagtgcatgaatcttcctgactccaattggcagcgcagtattcagtccatccatctgctgataccgaagcactgcaaactgacacatatgctcccttccgatcgccagcaaagcctccgtatcaatgtccagctgtttctttgtatccgcagtgtgcaccagcgtcagtaccgcaatcatcatcctctgatcgcgtgtagtcagatcattcaaaaattccttgctttccttccgctgcatctccatatcatagggaatggccgcactataattctggttcgcattctgccgcctctgccaatttgtaatattcgtctctacccccagcagccgcctttctacttcctgtactgcttcatcagtaggcacaggtataatatcaatgctcagcatcatattcctgttgatatctgccagagcggaaatcatattgtccttgatataagatgcataatctttcaggtataaaacacggccataccgctcccccatctggaagcaatcactttcaaacgcaaaactgtctggacagatggagtccttaaagtcatgtccttttctggcagagtccttcatatcgaactggaagctgctttcttcccctgcgcagtaaaaatcatgcagaatacgcagttttttctccgtttccatttccacacaggtgcttccgagatccgcaaaatgatttaccagactgtttcccattcgcaggaaataatttctcgcctcttcaatgccctttttatagaccgaaacagttacatacagctccttcatcagcccatttgcatcctgcgtcttgtcgagcagcatctgattcacctccttcctgaagcggtccagctcatccccctggtatgtcatgagtattttttctttgaattcctccttattcatcttccttactgcgacagtcagcttcacagtggccccactgtccaaagaatttaaaatatcgctgtaattccagaacattccctttttatcctcatgggaagccacctcataattaatgtccgtaaacttataagtctttgcatacttactccttcccactttaaaaatcccgtcaagatagactgtctgaatcggaatggcatcctgcactcttttcggcaccctgaatggctccttgtcttgtttcaatacatttcccaatgcctttatcatgttgttttatcccctccttcactttttgttccaggcagcttttcactgcctcgtaatataagttttccgggcagaacaccagatgtttcgggatcatgatctctgatttcagccacgcccaaataaattgttctgcgttcatcccgtgatacttgaagaatcccagtacagcaaatggagtcgtccccagcacacatacccatgaaaccgtttccgtccccagataaggatgcagaagaaaatagattcccactgccgccccacaagccaggacagaaaaaagaaactgccgcaaggacaacccgaaaaacatagtctccgtatattcccgtatgtcacggtttattttcacttccatacatcacctatagcaacaaactcttgacttctaatgatattcctcattttgttgcctttccttccacaaaatatttgcacatttgcaatcaacgccgttcctgttatactgttcataagaaaacaattcagggggtgtgactatgatatatgcagctatgctttcattaggaataactattgttttattcctgctttctattatttttaaacttgccggtaaattacgcctgccgcttccggtcatctattttcttttaatcagcaccgtgctgaacaaatgggctgcctcacatgagaaactggcttttatcattctcttcggcctgctgagcatcacactcatcagctggattgtatctctttaccacgcaattcaggaacgccgatacatgagtgcccgggcagatgatattaaatggcagctgcagcgctcaatagaaatggggatcccgcgcgatgccgtctatatagatgcccgcggtgatatgcgctatgaggataccgatgaatctgttttttaatatcaaatgctaacggacgtttccatacagggagcgtccgtttttataatcccatcatttcccttaccacccggtctgacatcttgattgtccccaccaataccagcatattaaatgttaactctgcaatatagctccacaccatagtcaccgctgcctcacttgtattgactgtcggcggcgaggacgcaaacaaggaaaatatgatacacgccagtgcaatgatcgccccctccaggcaaaccgctgcataacttttcagaaaactctttcccacattctgacttggttcccccgcgaatgttgataacggaaccggcgcaattgccgtatacaggtaaaccttaaagaaccgtccatatacagacagtatcatgataaaagataaaaccgtcaccagcagcccgcctatcagcgtaaccgcccacagcggaatgctttctaaaaatccacaatcttcaattgccgtcaccatctcctccggcagcacggcttccgccgtatttccaaagcctgctgaattcatgatggaagaaataatcccctggacaatcgtaaagagagctatcattaattccatcccataacttatgatgccttttgccaatgcaaagcgcacaaacagcttcaccgcatgttccgggcgcttcacctctgtgaaactgccgcatgtcttcactaccccaacaacaaaaaagagtacgagcagtgcatatcctatcgcctgcaatgctccattgatattgaccataactgcccatatccccccgcctctgaaggtttccggggactgggtcagcagctcccatatctccgaaagcttcccgttccacgtctctaatgccttcatcaggttctggaccacccaattatctgactccattcatccacctcctttccatgcccagccagcaggttcttaccgcctgtttcccttctctttatccggcaatcatatttaggatttcctttgcaaatgttataatgattcctcctgccagagtcaggaatccatttgctctttgggatggatcatgggatttcaaggacagtcctacctgcacaatgccaaatccaagaaggatcattccaatagccctgatcaatccaaagatgaaatcagaaagattatttacaacggtaataggatctccttccgcatgtactgtaacgcttccgatagtaagcaaaagcaccgccactgcatagatcataaaaagacagcgggcactgaagttcctattttttcgtttcctcccattttttctttctttgcactctttcttccgatccattttattgctcctcctttttgtcttagaaatacttatctaaatcggcctctgagagcagttcatagacatcttcttcctgccctgtttccagagcctgtgtaacatcaagcgtaccgtcaggtaatacacctgtgactatgctgacgctccctatcgccccgtctgcctctccatgctggtatggctttgcgcccccatccgtagtcagacctacattcggatgtttcatgatgtcaaatttataatcctttaccgctggttccccacggataaacaaaagcgcataccggttatccagcatacgcacttcatcgggtgtcattaactcccgccctgttatctgatagttcgtggaataatttcctgaatgccctgtcgattttccataagtattcgtatcaatagtggcttttcctaacagctcactcacgtatttgtgggtgccctgctcatttcctcccagatagaggaagctgtcacaattccctaaaatcgactcccactgcttttcgaacagtgccttcagctgcgacaggttctgcagaataatagaaacagatatccccctcgaacgcattactgaaagaatcttatcaaagtcatccggaagtgaaaatagcgataggtaagcctctgacttgcgtctcgggcttttcccccgctccacaccgtgcatgaaagtttcccctcacacggcgttccaccgactgattttacttcttagtatctatatagtcttcgaattgtatgttttctgactccctatgcttacggagcttatttactttatcttgcatttctgctgtaaggcttagggttctcaccattcgccttatggtctttttgttctccgctagaatcagctttgaaacatctgcagatataattattaggttccggtatgtgtcattcctttcaccatttaccggtttgatatgctgacataccatgtcatagacggatagcggctcatgtgttactgcacactttcctttttgtgctatatatcttgatagagcattatctgccatttcaagcgttggatagctttttgcattttccttcatgtatttcatgacttcaaaactgacacagttttcaccatctgaatacttccgtatatatttgttgacgcaacgccgtttatacttgggataaacataagatacatagcccactggaagaatcattcttcctttcatccagcggaattgtttcgatgctccgtacctttccataattactttactggttatctctccctctttttttaatggaatgcaccgcctgttatgattcacaccaaaatttctgctttcagcatctgcttaataatcataattagctttctgtcctgtattccaattccccacaactgtcggatgagcttattgtggtcaatgttgtcaaaaaatccaacgatatccacatccacaacaaaatgtagattttgtatctgtgccatcttatagcattgggcaatggcattctgtgtggagcgatagggtctgaaaccattgtttcgttcatgaaatttagcctcacaaacaggctccagtatttgcaggatacactgttgaataattctgtcccagatgctttgaatacctaatggtctggttttcccattatctttcgggatttccactcgcctgactttcttgggttggtagtaattcagtttgtttctaacggtttttatgacctcttcaatggataactcctgtatttgtacaattgtttttccatctgtcccgggagtcttacttcccccgtttttgcagatattccgatatgcaagcaggatattttgctctgataccacaaacggcatcagtcttttaaacattttctgattcctactgtcttcatacagttgatacccgacttcctttgcatcatatctctctgcatttcgctctgctttgtttacaattcgttttgtcatagtaatcagctccttatcggagattgattttttccggcaaccggggttgcttagtcacacctcgacagctatgaaaatctcctctgtagattactatatagatataaaagtcacatcagtatcggcttgtgcctatccctccaccgcttattatcacggcttcacaggtactatggcactactctcacaaccataaatgcacttataatttcaggggatatctgcccctgtcctctttcgatacaaacgaaattctttatcaccttacagcaggctctttcgttggttgctttccacgttccatataatctagcattgttatcacttaggtcgtttctttagccctgccagtatttcctggattctttccagaaaacttacgccctgtaagcgcaaagggaatttcactgctaacgaccattacttttccccacatggcgtacccgattggtacaccggcatttctaccggccattcctttagagccgtacattcgaaaactttgtcagaccgccttttggtcattctaaccttatgataaccccgcccgcactgtcatacacagcctgcatcactgccgacctttcctcacctttcaatgttagggtgtactttgcacgtcttccccgggcttataaccccggacattctgtattgtccggcgctatccgaagtattagcgtgtccccttccgggcgttactccttcatttgagacatcaattatatagttctttaaaatcactcattcgtgaccttaagctacggctttgtcggttattcctaccgttttaaccgtagaacgcgtcacaccattggcaaattcatccattacaaagtgcacatgtaccggcagactcccgccatatttgcggtcagccacataaaaaagctgctgaaacaactgtgtatataaaatgctgaccagaaaattaaaactcacatcattgtctggtatcagagcaaataacgccatcttctcctcccccatcctgtccagttccagttcatctgttgccgtcagagaagccagactctccaggttgaatttttccagccgtgcagccaatgtaatttgaatggatttcaacgttttagccgaacccgaatgataagcacggtaatacttcaatgcgatatgctccggttccctcatatccagacgttcaaacagttcatccaaagggctttgctcagagtcatcctcctcactcacatcgcctgcgcgcagcatctccataaccattggaaagttttgctcctcttttggagcctcatatttcagataaaaaaccaatgcaagcagaagcatggaggccgccgtatcccaaaagggatcctgtgattgggaaccttttggcgtggtagatttaaacaaatttgtaaccaaccgctggacatcgttatcattttgtaaataaacaaaaggattatagcagtgtgaccgctccatattaatcagatccagtacccgcaccacatatcctttggtttccagcagatgccctgtatcacgtaatatctcacctttgggatccagaatcaccattgagcagtttgcgctcatgacatttggtttcccgaagaatcttgtctttccggagcctgccccgcctatcaccacaatgttcagattccttttgtgcttcctgacctgaaagctgattcttacatttcgggtcagtatcttattactgcagaaatcatgatcagcatatttcttccccaatacttttggactcccccactttgcactgccatgctcctcccctttccggtaattacgttttgtagcataatagattccaatgcccattacatatgcaagtaaaaacaaaaaaactgttttcaagctgccctcacaccatacaacctgcaggggatgtttcatcgactctttcaaacctgcagcaatcttcatgaaattgtctgggagtaatggtgctgtcagcaacgccgcccatataacaagaactgcccctgtcagataaaatggcagcggcaattcctgtttatatccttccgtcatgttcccttatcctttccagcctccgttccagcacctctgtcttcctgatcccgctgtgaagatttccaaatatatcatccacccactttacctcgctttccctttccctgattttcgccctggctgcgcatgtcgcatttcctttttgttctgtactttctcaacactttgttttcctgcctccgccttctttctccttgatgctttcatctcttttagcatcccacgtaccgatggtttgtgatccaaatcagaagtacccctggcgtcgttccctggcctcctggaggatgtctctgacagagggcttttttctgtctcccccatagaagggtttccctgcattaggctttctttttcttcctgcactgtccgatgaccctgatcatcctttgctgccgttttttctaacaattcctctatagacttctttttttcagcctcgtgttttactccggcagtttctacagtagcaaatttaaatcgatctacaatccgttcaatcttggcggcatcttctgcccttaccataatatcgcacattccatccggactgccttttgagtcgcgaagagcacaatatagaacaccataccgcttagcctcttccttaaatgtcttcagatcggagttcctaacaccgtatatcttcaattcctttccggaacgcagcatggactttaaccgtgtcctgccgctggttttgttcttatctgcatcccggagtgcagcatacaaaaaggcagcaatattctttgctgccgaacctgtaatcttcaatacaacctcatatccttccaaagtcagacggacaatctgttccgccgcatcacctgacgtattcattgtggttcctctctttctcctggttttcctttttcccatactgtattgttttcataacagctattttctcttttatcatccccgatctttccctgatgccattacataatcgttcttcttttctgagacccgatatctgacatgtcagctctgcaatatcgttcttcactttttccagtgtttctgtatcttttaactttcgggataagcctcgcattcttgttctctccatgcccacctctctcatttgcgccttaatccctgcctgatatgcgtccaactgttctgccgtatcaatatgattcctgcataatagcttggtctcttcaaaaatccgctccatcttccgcacatcttcttttaatacgaggggcatctctccttgctttcgcctcgagggcttttgaaatacacctaatagatagcaataatggagacatagcccacgaaacccgccaatcttacgtgtttcacttttctttcccttcaccggaatcttccaatacttatcccctccgcctccttttgctcttatatttcctgctaagcgttttgaaggtttattattttcttccaatatcctcttctggatattttcaagggagtactccggattcttcctgtcaatccgtacaaaacgctcctttcccaatgggcggagtgtaaaatacttacggttcatttttatctcgtatccctgaacctccatataatgaaaaaattgagaaatcgtggcggacctagcgatatttttctcaatatcagctaatatataatctctccaggtcggtttcccctcctgtcttgctagatatgcatcataacttggccgctttcctgtcttcggattctcaattacggacaactggtattctctgcaaagccggtcggatgtttgccgcataaggtcataagatgcattgttgtcataatagcggcgcccatctgcaaatgaaaccgaattcagtacaaaatggtggagtagggaagcaccgccttgtcacattgctgtgataggtttgcgccaccctctccgggaaccgtacgtacccctctcggagtatacggctctgttgctgctcattcagacaaaactcactttttgtggataatactgcggtggcaatccctgcacaccacaagcgtttttctgtgtttggcaatcattgcgatttcccaccgttccttgcctttgagatttttgagtttgttaatgtggtgaacctcgtaatggtcgctctctgtcgttccgcataactcacagacctttgctttcagccggttttcaagggtattgactgcgtatccgtagacaacggcagcattgctgatgtaatccgtagcagggcccttgcctttgcagtcggcgtaatttgcgaagtaacgccttttgtttccctgcttcgtttcatagggtataccccattttcctgtgccatcattaaacttgtcaatggttttggataggctggttttatgctttgaagcaagggtttttaagcaactgtattccataaggtaggcaagatagtgcagcttgcaaaagttgcttgccataccataatagttgcatattcctcttaactccgcattgtatactgaaacgatttctaagtctgtgagcccaaccagatatttccgatgaactggaaacatggaaccatctttcttctgtatcgccacacctttagtgaaaacgaattgacggattttatcgttaagtggcaccaacagttctacacccccattgagggtacgcatttttacatgaccggggccaccccgctttatttttccgcttctgcgcacacgcacatcatagcctaagaaccttgcacatttactgctatgggttatgagcgttttatcttcactgagttccattttcagtgtatctccgataaactcggccagtttgctcttaatccattgacagtcctcacggtttcccttgactgctattagaaaatcatccgcataccgaacatatttcagttttttgtcggtctgcgcagtgcagggaatggtcatcagtttctgacgtttgggcttatactctgccagcaccatttccctttcctcacctgttactttcgtcaagcggtgggatagccgtttgatttcattgtgcagctctcggtattcaggtgtgatttgtcccactccgggcgtgtcaaattcggatttcaacttcattacaaacttgtccaattcatgcaggtagatgttggcgagtagcggagaaatgataccgccttgcggtgtaccgctgtacgtcttatggtactgccaattctctaaatatcctgctttcaggaatttgtaaatcagcttggttatccgagcgtccttgattttattgttcagcaagcctacaagaacagcgtggttgatgttgtcaaagcaacctttgatgtcgccttcaacaaaccaacgcgtaccgttgaactcccgtctcaactgttttaaggccgtatgacaacttctttttggcctaaaaccgtgggagacatccagaaagataggttcatataccgcttccagtatcatccgcaacacttcctgcaccaatttgtcagtaaaggttggtatacctaagggacgcagctttttgcggttattcttcttctggatataggttcgcctcaccggcatgggctgataggtttcgtctgccaatgctttgataatactatctattttggcttcactgaaaccgtccgccgtatcctcgtttactccttttgttgccgcaccgttgttggcatacaggtttttgtatgccacaaagtaaatgtcaggacgcaacagatagcgatacagttttgtaaatacttcttctttatttgcaagtgagttttgactgattcttgctaaaatttccgttgttggcttcatgtgaggttttcctccctaatcaacttctaattttagtgcgcaataactgtgccccttcgccatgtaagggtcattacccctctcggactactacgagcactccgtacccatgcaggattttcaggctccaaagccatagccgctttttcattcctcctttcgtgcggcactcctggttagggcatccccggttagcaatgagacttggtaaattcggattctcggtatcgctttcgcttcgttaccataggttcccctacaggttgtacggaatgattgataaccgacaagcccacaaccataacttgccttttccgtaccagaggtttcaggcaattttcctctatcggcacataacagaaactggaagctcacgttcagtaaatccaacttataccttatatccgattaacattgcggttcagtcgcacccgattgcctttaggtgacttaccgctttccagccgtactgtgttcccgtgtcagctttcgcctttcggttaggctggttgtttcccgcgttatcttacggggcagtacctcatactgcttttctcattgccctatccgggcgtacgttatgaatatgggccttatccaaatgggttgccacgatcacctcgaacctggacccccacaattcctctgccagcttcaccccaatttcatgggcctgctgtggggtgacttctcctggcataaaactctgatatccgtggtatgcaataatgcccccttccttctggtactgtttcttcgtaaccatcatttcctgccttgctgtttggggatggcagttcagccccgttacgtaatactgctgttcagtcttataatcctgcagcatataatccatgacatcccgcagcccctgcagatcctgccgcgaaaacttcacattttctgttttctcagcattatttacataatcaattacatgatccatcctgcccctgacatcccatatctttgtcgtagccaattttaatcacaccttgtccggcagcaaaaacttctgtttaatttccagttggaaccttgtccacctgtctgcttcttttttgtaatagggggcatcgatgaggcccagcacatttgcctttgtggaaatctgatggagatgagttcctattatattcatctggcgcatgacatcatagaattctttatccggtttttcatgcagtatataaccgttcaggacagcacgtataaacgcctctctggagagccccgactgttttaccttccgatcaagctccattgcctctgtctccgtcatccggaacatcaatgaaacatttcgttttctcatctgtccctctccttttcctttggtattgaatccctcagctgagacagcttccttgcctcacgattatattcataggcacgatcagaaagtacctcctccggctccacctgtgttgcattgatttcccgtaccatctccccaagttccctggcctccaggctacgacttttggggacaattataagttcgtgaatcgaagatggaaggatatgaaaatcatcctgtagacattcccctatatttttcagcacgcccggatacagtatggagcttgcaccaaatgaattgctgccattagtaaggacatacatctgatcttccggcagattcctaaatgcttcttcatccacaaataaattaagcccctgttcttcggcttcttctccaatcatgttaataatgatatctcccatccgcttaaagaccggtggttttatgcgctgcatattttccagtgcagttccatagagttcgccttcactaatattccactgctccagcatttggttcgttatcttagcatgcatctctccaccgggaatgtcatgctctacctggtagatgatagataaatcttctatattcttatgaggcaccttcttaagcagagacgaatttgcttttttgttaataatgctgcacgtgataaaatctttgacatactcatatctgtccatctgaaacttctgtaacaattcctcagccggcatagaatctctgacggtctctcccagccgggttaatatctgaaccatgtcctccccttgaagataggatttgtagcattcctcaagataaaccgtgggagatacgttaactccctgcggcttgatagagactccggtccggatctgcccgttgttcttttctgtgttcatcaggctcacctcactgccatccaactcttctggtaagtgctgtggcagatccgcctccactcgctgtgcaaattcctgaaacgtcatcatgatcgtatcactcccttcttcacggaacgctttttcatctggttctgataggctgacaacctgcttatccttcttcgcttatccactttcctgctattctcttttttcatctgacgatctcccttcatattgatttatccttccaatctgcaccaaacaaattgcaataactccgcagaaactacccaatataaatccaagtcctaacattagtgccatgctcattttttctccttccagcattaaacaggggattggggaagctccccaaccaacgaattcgtctgccggaggcaagccaaattcagtgctggttaagacaatgtattccccgccccagtttcgtttcatcattcatttcttataaactgactcatctctccgtttgtatcacctgcttctttttccttgctttggtcacttccagaccctgtctgatgcatagacaatcattgcaatccttcccgatttctggcggcctgtcctttgtcacatactgctgcggaagtactgtccgtattgcctgaaccgcccgccgtcctgccggatcgttatccaaatggaacagaaccgtctcaatttccggatgtttctgaaggcatcgttcaagcgctgcaggaagtttactcttttcaatttcttttgcaggctgatacactccggcaagtgataacaagtgctccgatctccaattcatcctctccagtttctgcattgtcgcataagaaagcaggtcgattgctgactcaaataaatgaactgttgatgattttccttctgcaaaaatagaaaaggaatatctcttatcacttccgttcgcatctcccagaaagtcagaattgattccacgaagggctgcataacggggttttccagcagaatctttcccaataaatactgcattctgatgttcccgcgtctcgcatatcgtgcctgtactgacacagaattcaataatctcccggtctatccctctgcttagaagatacaaaatgacatgcttcggatgttggcagagttctggaagaagaagttttttctcccttttgtcctccttctgtggaacataaacaggtggagcgatcgccgcctgccctgcaataatttctactgcctccgtaaaagaatatccctccaccttaattaaataatccagtgcagacctgccgcctatccccctgctccaccacatccatttaccatttgaaatcttcagtgaatcatgagttcttgtggtatacgtgttgctggaaaaacggataagttcatagggttcatagtttttcaaataggtcagcaggtccattttctttacttcctgcacgacttctggtgcaatatatggcatcattttcacctcctctcaaataaaaacagctggtcggcaatatggttcaccaaccagctatgtacggaatttcctgatatgtacttgtattattattgattgtactttcatacttccaaaaaggaaagaagtgctatagcatcacgcatcccaagaaaataaagctccatccgctccacatactcctgattatcttccgcatacaggaaatcagacaatgctttcagttcttccctggaaaacgtgcgtccttccgttatgctgtcatactcatcaaatatggagataaacggatatgcttccagtaattcatcagcctctttcataaatctcgaatattcaggacaatgttttttggctgcttctctgacacgttcatccacttcatcgaaaaatgcattctgccacagcgacatattcagatggttaaagtcacgcatttcctgaccgcctccagttcctttttaatactttaatatcaattatgtccatagattttcgcctccttcatttacaatagaaactataaatgagaagcgcctgcaccgcaatgatacaaacactccagtatatgtaccccctgtaccaatcttcggcacagggtaacttcaacgttcttcacgctcctttgctttatgaaatggtataatctctgcctctgatacctcctctgccagttccatttcccgaatgtatcccatttcactaaaactgaacttttcgccgctggttccggctatgatgatatggtcttctatatgaatccctaataactttccacatttccacagcctcctcgttatacgcttatcctcatttgaaggcttcagacttccactgggatggttatgcatcaggatgatagagcgggcattggataaaatgctgcttttaaatacctctcttgggtttactattgcctggtcaactgttcccatgcaggcaatattaatattaatgatctgcccattggcttttaaattcaggacacacaatacttccctgtcatactgggaaatctcccttcctacaacttccactgcatcactgggactatggataggtctttcacagtatagggagggctccttaacaagccggatattcactacctccaattcattcatcttctgcctcctgaatcataatgcaaagtatctggctctcttccatagcatccaccacttctttcagttcgctgaaatcatgaatgataatttcttccatactcccgcctctccaattcacaactggattcctgtttttgctcagtatcccgtgcaatttctgaatccccctgtcctatatctgcctgctgctttgaatccgtctcctgttctgcttcctgtggatgccgcctgcctaagaatgtaatcaccttatttgatttcacatgtttttgtaattcattaatgacggcaagttcagtcactgttatccccggcatcctgagcatatcttccatactcatggaaagaatcgatttttcagtgtcatatccggcatccaacaacttattcaacgttctgactgcctttgtgttttttgccatttattttccgccccctcttctttttataaacaattccagctattataagcgctgctgcagaacataatacagctaagatcaacaacacttctgacctgtctcctgttttaggcccctgggatacgaccagtttcttttcgatccctttgtccttcatttctaccttctgtatctctgccgtatcttccaatttaaatattacatcctccgctacctcataccccttcggtgccgtaacttcccgcaaaatcagattcactcctaccggaagctggttcactttgtgcgaaaagccatccgtaatccattcttcaagaactgttccttccattgtcagaacctgtagttttgcacctttcagttcttttcctgttgtaatatcagtcttttttatttccacttttgagatgtcatccttcatttctacttttgccacactgccatccgcctttacttgaaaatccacatcttctgcggtaacatagccctcctcaaacggtgcaagttcttcatgcaagatgtaagctccttctggcagtccatatatgacatgttcttcttttccactgacccacgtttccacaactttgccatcctgatccttaatctgtaatctggctccttctaattcttttcctgtggttatatccgtttttgtgatccgggtttctgttggttgattttcaaactctttttcagcagtaataaccgccagtttctggtcttcataagtcaccacaatctcccagatttcttctgattgcagataccccggtaatgctctaagctctttcacataaaaggaaccatgaaacaggtcgctggaaaatgtcagctcaccattctcatctgtgcttttctgctcaatcagcgtgtctttttccagaagtacctcaccgtcggctgacagaatattttcttttgtatacaagccaaaaaccacgccctgaagagcatccccattcactttgtctttctttttcagactgatttttatcttttgtctctcattcataaattcgaccttttcatagacgactgcagcagtatcatcctcgctggtcagtataaattcttttatctccgtatttaaaacaaaatgctcccctgcttctacctctttcacataataggaacccagaggcaggttattgacagtcaccttccccgtgtcatctgttgacaacgttgctaccacatcatctttatggtagcggataactggattcccttcattatctttggctccatccggactggcaatatcctcgtttgccctgacctcaaaaaccgttcctgcaatgcctccctctgtatatttaaattcatggaatacggtatctgaccagttttcgccagtgactgcttctttcactttattccagataccttttgttttgtctaccaaagagtctcccgtaatggattgcagctgttctcctgccttaacaatggtcagactgcctacctgctcattattcctctgatctattgttaccatcggtgtcccgctctctggatcaatctcagatgcattaccagactcaattgtaatggtaatcggctcctgttcctgttttttgtagactccctccatagcgagatctaaaagagatacctttttatcccccaaaaacagttccttttcacatccggcccgtacaaaactcgctggagcttttacttcttcaatcctgtaagttcccggcttcaatttctccggtgtaaccagaattccttcttctgtagtggtaaatacactgattttctgcttcttggggtagttaactgtctgttctacatatttcttggctgcacagtcatagatcttatatgaagctttcttcccaagaactacatttccggtctgagcatcccgctttacaatcttcagaaagaactggtatggcctgtcatcaaatatacgccactccattggctcccggctgtcttccgttatatttactataaatgggttcaccttgttcaaatttcctggaaccgtgctttcttccaccacgtacattccatatgcaagttcaggacttgccagatagcctttgttatccgtaaataattcaggtaccggtactgccttcttatcctcatacgtaagagctgtggtctccctgctgaaatcatagttcacaaagtcttctgccgtgtaataagaaccattctttggtttcaatgtgccatccttaacctttgtgagaccgcttatcagatagactttaaatccggcaccttctactaagtctgtttctgtctgctccccatcctcgctgattttaatcagggaaaatgcctgcttcttcacctgttcttcaacaatcaggtttctggttacaattgcctgctcctgaccggcatagcttagtgttgcatcatattccatcggctgaaccagataggattctgtagatgtgatttcttttacatacatctgccccagatataaatcctcaaaggtgatacttcctttgcttcctacagttttctgagaaatcagcgttcctttcggatacaaaacgcctgtccttccatccggatgcacgatatcttcttttgcatagagtccgaaaactgctccctccatgcttccatctccctgaggttggaaagtgccggtctctgcatccactttctttagagtaatcttccctttgacagccttatctactgcctgtatagtaatggtttttcctgcctcgacatttactacatgggttgactcatctttcagataattaggcgctgcagtaatctctttcacatatactgtttttatgccagcttcaaaatacccacttatgcatttcccatcactgcctgtgactggcatttccataagcaggtctgtgcattccttattcctatatatgccatacactgcaccagataatggattctttgtatctgtatccttcttcactaacgaaatccgagtcatactgatccagtcaaccgaccagctgaccggaagcgccgcttccgattcaaatacacccacggcctgatctacgtcaccggtgaagacaaccaatgtccgccaagtctctctaattgaaccatgtaattcccctgttgaatattttcctgactgagaaacaggagcctccagataaaaggtgtccccaccattaatggtgaagcttcccgccgtaacactcttgtttttcgttgtatttacacctgttactccggttggaagattcatcgtaatatgattcctgtaatcaccattcagaacaatatccggcgttctctgcttctctccacttctgacggccgtcacactgttggctgaaaatgacagttccccttttggcggttcctccatacccagcagcttgtcgatatagccgataacgcctgctgcaacaagattctcatatggacagcccgcaaaaccttctattccggcataagcataacttgctgcaatgtgtgtaaagacatatttctgttcatcactgaaatccggcatataggtccctgtgatatcaccggccccaccatagccgtagtacaatactttctgcagatccttatttgaatccagcacttctcctacataatcgcctgtcggcggagtcggtttttgtgattcgatacagtatgccagctttccattcacgtaaaaccagttcgtagaatagtaaccaatgttttcaggataataaattacatcaccaacttccagatagacatcctcttgtaaattgatggagttcacagtagaaaacagtaaggtttctcctgactgaagttcccgctgtatctctttctgctcttcttctgtcacagattcacctgcagattttatcttcaattccggtgtttcctgtgatacaggctgaccatctgaatcatccgcctcagtatcggatttacttttatccgccccattctcctgcgtatatgccattccttcggtatcagtcagtatcacatttctctggatggtatagctttcactctgatccttgggaattaccagatacgtggcaatataaattcccgaggtctgcgtgtcagcctcttcgccattctcgtcttttacagacagcagcgatacagtctctctgtccggattgtaggatatcccctcaacagatgtctgtatcgagaattctacatccgatatatccttcgtgatatcaacagcagtcacgctctgtgcttcatctgtttcttgttgatcttcttgggtctgtgacactacattttctgttttcccatctgcatagacagtcgcagaactaagtgaaggtgcaatgctcaatgacattatcacagccaatgccaacagcctgctccatatttttcttttttgtttcatcttctttcctccttgtaagcccgtctgccataataaatacaggcataaaaaagctccgccgcagcagagatctgattgtggaataaattcttcaattgttttgtggctagccacattcctataatttctctttccgctggtaactgctggtaatctgaaggggtgaggtgtggagagggggaactcaaacttttctcgccgtttagtggaacatcccactttccccttggtgtacttccgtggtccttgctcaaagcaacatggaattttacctttccatatctttgtttctctgcctcttttggtacatctccagcgcagatactatcgtatcctccatcttcttttttggcgtcccttttggaaaatatttgctgatacgattctgtggaatcttgaattgctccacttgatttggcttttcctcctgcaggatcgacgcaatcacagcttcttctaactttccttcttttgaaaatgatttcattttaatggcctgtgccagagatggtgtacagtcctcacttctcatggaatccagaagagattcctgctccgctatagtaaggtaggaaatctctactgccgggcggaaggctattttattgttatcgaccatttccaaaatctctggtagaagttctgttagtctaatgtaccggcgaatttgttccctactgtcttcactttgtgttgccaatagatctcttgatttaacaccttttgacttgtgctccattggtgcacaagttaaatcagcccgttttccctgccttttcatagcatctaacttcattttgtacgcgaaagccttttctgatggcagaatgtgttctctttgaagattgctatccaccataatcaaaattgcttcgtcatctgtcaagttccggacaatacatggaagatcagtcttttcggtcagaatagttgcatgctttcgccgatgtccagctaccatctcataacgaccatcctcttttggcctgactaaagcaggaacaagcacaccatattcctttatgctggtgcctaaatcaatcatctctgaatcatccaatactttaaatggatggtttggaaagtcgtcgatcagatcaacaggaatgtccattaccttttcaaggttctgttcttcccgcttttcctgtgtcgtaaacaggtcatcgactgagggaaggtccagattgatgcctttgcttttcgccatctctcaacacctcctttgtgaacgattcgtaagcctttgctactaagctatccttatcgtaagcataaacactcttcccttcagcagatgtctctgccgcagcaatagccttcggaatttctgacttgaacactttaacagcggttccatattgctcgcgtaatgttgtagaaacagattttgctagattcgtccttccttctactaacgtaattaagattccctccatttttaattgtggattaagctgcctttttacttttccaatagttttgatcaactgcgtcatcccttttgccggaagataatgagcctgaactgggattataattgaatctgctgctgataatgcgtttatggtaatcataccaagactgggcatacaatccaaaaggataaagtcatagtcctgctttatctgttgcaaataatttctaagaacatattccctgctcattgcagttaccagagacatttccattgcagatagttcaatattagcaggtattaaatctactccctcttgatggtgtaagattccttcctgcggttctattggaatgtcttctatgatctttcccatgattgttgataatgttatggggagatcatcaatatctttaaagccaagtgatgttgttaaatctccttgtggatcggtatctactaccagcaccttctttccctgattggctagcccaattcctaaattcactgttgtacatgtttttcctgtacctcctttttgatttgctattgcaattattttgccatcgggcatgattcttttacctccctgtattcaattggcctgtatggagacgtgtaaacgtcccgggaatagcagaaattctttttcggttggttaatctaaaaaacgcagactgtatttaatccataaattctcctcccttcataatttaaaccatccaaaaggacggctatgtacagaacgcaaaaaaccgcttgttctatttttaagaacaaacggcttaaattgatgattttaaggcaaaagatctatataatgctttgaatcttgcaatctattattttcagcattataaatataatatttattaccaccttattttctctatataaccacgatatcgttgtcattaacaagtattgttttcaataatccatttttgaactataactcttactataatgctgtaatcgtggtttttgttaatgttttattctttatttctgtctggatggccgtatacaaatccacatcaatttctggtgcttctattgatactattaatgagtatctaatgtatgaattatatttttttaagttcgtccttgatttccaccatccacttttaggataaacaattatcagattactttcagataattgactggctgtcccttcccaaatatcagaatgtattgaacctacatttcgattatttacccctaatgtccaacgtgaactatcgtttttcacttcacccttttcgttttcatcttcgcgcatttctttactaattcgttttgtaaaattttctctgtcttcagttgggttattaacatcaaaagataaaccgcaagaaggatatctatacttatctttccatccaatttcaccaggtcccggctctatatagtatgataaagttactcgcattttaacattagcattttcacaatctgaaagcagttctttcggccacggtaaagtatgtatgtgcatttcattgcaagttatactgccattttcctttttaacaaatggctgtaattcatcttcaacaatcaaattaacactattttctgcactccacatcgctttatctatactgggaaccccatagccgcaaattctaagtaacttcctgtattcatttttcgacaacttcgaactgctactgatacttcttttcatttctttagtccaatcagcagaatgtatcattaaagcccgtacagtttcaggccacaaatcaggataattgctccaaatcttagccgccatccaagatgcttgtgctaccgcggaactagtcattgaaataatatcaaatggccttctcattaaatactgattgcttgtcgtaagcagggaaagatcctctgcctcagtataaaaatcatcgtttttactatatgcaacatttccaccttcaaaaagtatttccggcttaatcggccatttattatggttccaagttaaagacgacgaagtatacggggaaaaatcaccacattccgctaacggctcgaatcccttatataatggattatctatctggtctaattccgtataagcccctactgtaatagcattccatgcttgtccgggatcttcaacagaatgatttactacagcagccttataattactagtatcttttaactcctcaagagttgtatttccagctgaaacaagcatcaacttcttagcctttttcaccgcttcctcttccgcttctgaaataatagcatctaatgctcctgaccaagatgaaggtctgccatccttatcaatatttgtatttgctgttatcgccatgcatattacacgatttgtatcggggttttctatttctgctaagctaattgcctcggctgtcaattcaccatacaattcttccggattatcatctggtctatccatcattttaacggattctaaaaaatgatacgcctcaaatacatccattgattccagtttgtcctctaacgtaaaaaatgccgctataccggccatattcgtgccatgtccattcttatcttcaggaccttttgacaaatctatagtctgtctatcagtatcttttaataatttttctagtaaaggatgcccattgttaacgcctgtatctaacagacataccgaggtatccgtcatattttttgtgctaattctttttgctaaatcatcactccatgctctttgatccgcacccttcatctcaataaaaaaggatgtaagtacagacatttttctgtattctgcaattcttgaactatatcccaataactcggtcaattgtcttccatctgcattaactcctactacgattctttctggaaacaatatatgttgtgttttcgtctttatgcccaaacttttgcaaaggctgaaaaactcgttcttaactttagatacatcttcctttaattcatagcgcagccagacctcacaccatatgcttttatcatcttttggaattgcttctttattaccaatccagaaagcttctaacaaagctgcttgtatgctctccactgtaccgataacatctgtgcccgactctcttccaacatatttttcaattttctttataaaaaactcgtgctttttattaggaataaagatagttgccgatataacattatcactatcagtttgtatgtttgccaacctgattccctgacttgtattttctaaacttctagtcaataaatcatagccggcttttcccttaacctgcaggtaaacgccttctcttgcagatgcagaaacagccaatttgtccctgcatgacttctctgcttctttccatgcaagttcaaattggctttctatccattttccatgctgaattctattgcttcttggaggataattcgtttttccactgcctcctgtaacaggtttatattttaaaccttcccctgcctcattaatataaatattctttaaatttctacccatttagtatattatgcctccttgaatctataaaggcctttcctatcctgtatatatgataaaatcattgccttgcttatgttttcgtcattgattaatgaatatttaattgcctcttcacaggcctttacgatatctgcatggttcaatcctcttgcactttcataaacctgatcatcaaaaacatcatttagtgccaagccatccaaatgtttttccaatatacattgtatttggcctaaatccggcaacttatattcaagtacatcatcaaaccttctaaacaatgctttatctaataatttaggattgttggttgcagcaagaataatactatatgaatcatcattttccagatactgcaaaaatgagtttaaaattcttcgcatctctccaacatcattatccaatgaacgatcagaacctatagcatcaaattcatcaaaaaagtatatcccttgtatttcctgtatgcaatcaaatacctgtcttagtttaacactggtttcacccatatattttgttaccagcttatctatttggataacatatagcggcaagcccaattcgtcagctaatactgaggccgtcatggttttcccggttcccggttcacctactattaaaatcttactacgattcttcaaaccgttctttcttagaagatctcttttacgatattctgtaatgattcgctgcaccttaatctctaattcctctgacaaaaccaaatcatgaaagctaaattcagagattttctgttctaacatgtcgtattttgtattaaatttaacaagttttttctgagctttatatttgggattctgaacgatttctttaatttcacgcgcacttgcagtatggcctattttcgcctcatgagccgctatctgaagcgctatagacttaaacttttcatcgttatcttcaaaatgcattctcattaatgcctttacttgctcaatggtagccatactttcaccttctttctactagctatatattatcatagtttattcaatcctgcacgaaatattgtaataattaacactaactcaatcattatttttgtggcctaacccttctaaaattattgctatgtattcgtagcatcaccttgcatgcgctcattaaaaactaatacgcagatatcaaaaaagctacggcgtaaccgtagcttatcataacaaaactcatccaaatataatttgtcgtaaatttgtcgtaaatctgtcgtaaatcacctttccaaatcacggaaccccttatgtttactggcttcccagactttggatttcctttcgaccccgaagaattcattctattctataggttattataacccattgtatgtggttatgcaagcagtttttttggtcaattttgccaaaaatttcacgtagatctttgtatctcgttataagtaatcttcgaaatgtcgtaaatttgtcgtaaacgttgctgtgaattctgccgtaaaggctatcaaaaattcggatttatatctgcagaaatcagattacagccctctgtttttcctcttccattggcttcttatttagttttttcatttgctgacggatacgttccgggttcactgattcgtaaacctttaagatcattttttgagtatccatcatcttcatgttttggcagattttccaataatttttccctcaaatagtaatttacggctaacaaagtccaaacattactttacaaatctgctttccacattctgttctgaaaatatgattatacgcatttaaagccgctgtttttgacaggttatcctccatgatatttacaagaaaatccgcttcaacaagtatttgatagtctattccatcaatattatcgtacgtatgatgatttgctatcagatactgaactctttcagatacgtaatcttcaaaccccaaatctttaagtaacttttttactattgcagggccttctttttcctgtaattttccgctacaatccccatacttttcttcacatatgtgaatccctatgtcgtgagtcagggctgcagcttcaagaatgaacagacatttcccatctacattttctgtttcagcaattagtttcgcataactgtgaaccttgcaaaaatgctgaatcctctttgcgtccccacgatataactctatcattgataaatgtaacttatttaacatttttaacactcctctaaacgaataaatatttgtagtattaacgcctccaacgtatccaataaaattaatataaaacggtttatccattcacagctctcgtaaacgggtagaccgttgccgactatacacaacattcttcccttaaattctggattgtcgatttgtatttgcattttaccatataagcctgagaagttctatttattttcttttaattttaaggaatagtgggcagctgcctatcagcttcttgtgtatttctttatcacacttgagcattttgacatagtatatataacctgtattgaaaaacgagctgtgaaattaggtgattcaaatcgagtttccttaaaatctgcatataatcattgttctgtattggcaaagatggactaaaaacaaatcaaatgcaagattgtattgaaatctgcggaaaaagatattcaaaaatctaaggaaggcttcattcgctagagaggttctcctcatttgggaatacaaaaatcttcctgttttttatttccccaaaatcaactgctccccgtccgctgcaacaacagcgcttcgcctctccttatcgtactgcaccgtccctccacttatgctccggatttcaggaacattgtaaagtacatatgttatcctttcatttttcccacaactagacaaataaatcttatctttatccgcatatgccctcacattcagcacaatattaccatctttgtcggggatccggcattctgctttctctccctcccgtaattcatagataccgatctgcacattttccgcgaaggaatacccggctgttttttcattgcttcccatcgggagaagcgaattctcggccacgaataaaggcagggaatgataatcgtatgtttcccggtaccagcgtcctccttctttccgttctccgttcagaaggtgcgtccacacacctttcggcaaataatactctccgattccctctttattaaaaatcggcgctaccagaagacggtctccaagcatatactgcatatcgagatattttactgcaggaccattttcatattccaggatcatcggtcgcatcacaggaattcccgtcttgtgcgactccactgccatactgtagatgtaaggcatcaacttcaatttcagtttcgtaaattctctgcacacttccacagattcttcgtcgaacaaccatggcaccctgtagcttttggagccatgtagtctgctgtgagtggaaagcagcccgaattgcagccatcttttatatacatctgcatcggctgccagttcaaatccaccaatatcatggctccagtaactgaaaccggagagcataaaggaaaggccgcctctcaatgattctgccatagattcatatgtgcctgtacagtcgcctccccagtgtacggggaatctttggcctcccaccgtcgcacttctggcaaataaaactgcctccttttctcctctttctctctttaacaattcaaataccgtctgattatataataatgtataataattatgcattccccatgcatctgctccgtttgcataagtcacatcaacaggaatcctttcaccgaaatctgatttaaaacaatcgactcccatatccagcagttctttcagtttttcctgataccaaatcacagcttccgggttcgtaaaatcaatgactgccattccaggctgccagttatccacctgctttacgcccaaaccatcggcgcgcattaggaaatagcctttcttcaacccctcccggaagaatcccgttccctgtgctacatagggattaatccatacgcatattttcaaccctttgtctttatatcgctttaacattcccctcacatccggaaatgttttctcattccattcaaaatcacaccagtgcaggcctctcatccaaaagcagtcgaaatggaatacgtcaaacggcagatcccgcgctttcatcccctcgataaatgagttaacagttttctcatcataatcagtcgtgaaggatgaactcagccagagtccgaacgaccatgccggaggaagtgccggtttgcccgtcagactcgtatagtgctcaatcacttttttcatagaacttccgccaatcacataataacgcatctcctctccttttacggagacgccgactgcttctaccttttcgctcgcaacctcaaaggacacgtctgtgctgtgatccacatagattccgtaatttttattcgttatatagaacggaatatttttgtaactaatctgcgatgaagttcccccgtcctcgttccagcagtctacagtctgaccgttttttacaaatgcggtaaacctttcaccaagaccataaacacattctcccgctgccagtgaaaactctgagacaatataaggattgtagtcctcagcaagataatttgtctccgggtacttggttgaattttttctgtcatgtctcatgtatccgacatttttaaacccacatgatgtcatatctttcccgtttcttttgtagctgatatagaactcttttagtcccacatgtacactaacattccctgctgacatcaccgcctcatcctcgctgatgtctatatttactttacatttttctctattcagcataaaccggggttctctcttttcgtatccttcaaaatgaaaacatcttacggaaataatatcctcgccggctgaggtaaactcaaacgtcagcgttccgacgtccaatgcgcctgcgcggctgcagatggtccggaacggagcaatcaccctcatgccgttttctatttcttccacttcgtacgcctgtaccgcataacatgcgtgagcagcctcgctcttttcccagaatccctctgtaaatttcatggcttactcctcctgctaatgttctgtaatacttccgcctttgcataaaatcctctcgttctaccgtcgattactgcactgtcagctacttgcaactgttcctgaagacggatatccctgcaggacgctccaagcgaaatgatgtaattccccttttccacaaaccattgcatgtcacggtccaagaaggcaaactgagacaccttcatctcaaaccgcactttcttttcttcgccctttttcaattccactctcacgaatccggccagttccattgtcggacgcaccatctgcgatacggcatctgtaaaatacatctggacaacttctgttccgtcacagccacctgtatttttaatccgtgcttccaccttgatgacagacgacgcactaacgaccttttcctcgattttcatatcagaatactcaaaagaagtgtagctcaacccatgtccgaaataatagagaggctctgccgtatcattgatatatccgtttttattccgaatcattccggtgtgcccagctgcaacatagccgcttcctctcggaaggccatagtaaatcggaagctgtcctgcatttcttgccacagtgaccggaagacgcccagacggattcacctcgccgaaaagcaatctgcacagagcgctgcttcccatttctcccggctgccatacttccacgatagcattgaaatgtgacgcggtaaactcgtttgacaggggacgtccgtcataatgaagtacgactgttttcttatgtaatccgtaaatttttctcgcaaattcctcctgtgctcccggcagatcaatgtcggtagcatccacgccctccccaaccgtggaagtacttccccagccatttttacctccgagcgtcagcaagactacatcggaatcggccgcagcacgcactgcctcttccattccgccaagttcagttcctgcacagtttatcccctttgcaaataccacctctgtgttaggaagatattcttttaatttttgataaagtgtttttgctttcggaaaatctttctgtatccgcttatttaccctgggtgaggtatcacgaacctgtcctatataatcctgatcaatatcatagataatgactcccggttcctcaaagtcctgcccatcttcctctctggacatcgtcatatcgattactgcaggataagaaaatgtcccgaacaagctacggatgttgtccgcatgaggaccaactaccgcaagtttttttatctgttttgacagtggaagaactttgttctcatttttcaataaaataaaactttcctccgctatcttctcattcagccgctctgtttcttctaaatgtaatgtcttttttagttttcttaaatccggataagggttttcaaaaatacccatttcaaacttcattctcagaactctctccaccgcctgatcgatcacagatatgctcagtcgcccgtcatttaccgcttctttcatgcagtaatggaaccctttcggtctcggatactctacatccagcccggcctcaattgcctgaattccggcctcttcaaatgtggcggccaccgaaaatgggtctaccagacggtccactgagagatagtcagagacaacaaatccacggaaaccaagcgcatttctcagtatttctgtaagcatctttttcgatcccacaaccggttccccatcgatggaaccatatgaattcataacactcttcaaattggcttccgttattgcacactggaaaggtttgcagtgaatttccagaagatctctctccgaaacaagattgcgccccatattgattccaccctctgtgacgccatgcccagcaaaatgttttgccgttgccaaaataccttttttcatatcctctgactgaatccctctgacaaaggcactcgacatcgccgatacaagagccgcatcttctccgtatgtctctgtcattcttccccacctcggatccctgtccacgtccatcacaggagagagtgcctgtcgaaatcccacatatagcatctggcggcgtatgatatccgccatctgctccacaatcgccgggtcaaacgtagacgcctgagcgattgcactaggaaatacatcagcctccgtatactgtgcccccgcacacgcttcacaatgaatcagtgctggaattccgagccttgtctcatttaccagatatctctgtaatttgtccgcgtacttcacaatttcttctacactgtctgccacagtaaatgcgccaacattccctattccgtttggtacatattccttaaaatcaggaatctcctccgtgattgtcacaagacatgtaatctgatcgattttctcctcaaatgtcattctctgcattaggtccttaagcctttcctccaccggaaggctgctgtctttgtaattcgccatctccttttaccttctttcttgcgctgtctttctgaatggactgctttatcggattatttcagatactcgtccacattttctgctgtgacgattttaaacggaatgctgacatcctcgatatctgccggatctgtcccgtttttcaggtcctcgaaaatctgagcacccgcttctgcctgtgcttttgcatcctgcagagaagtcatcgtcatttctccgtttttaatagattccagtgcgtcatcacttccgtccacaccgagcacctgaatgctgtcctgttttcccgcagatttcaatgcctcaacaactcccaatgccgcatcgtcattctggcatacaattgcgtcaaaactgtcatatgacaacagacagtcatccgccgtactcattccgagatcttttgcgttttccacgttatattcacctaaaattgtaatattactgcctttcagagcatcttccagaccctgtttacggtcaatatactgctggtcgtttggtgctcctgtgaagtataagatagatgctccttccggaaatacctctcgaaggtattcaccctgtgcttttcccgcgtcataattcggagaaccaacataaatatatccgtcatagtcatccccgcccgaaaccgtagtcaaaaatgagatgtaaggaagtcctgcgcttttcgccgcctcaagagccggtatagatccgtccagatcgttgctgatagctgaaactacatttacgttctgtacaataaaatcatcaatttgtccgttctgtacatttgtatctccacccgcatctgtgaccgtaatatcaattcctttcgcctctgtcatctcttttaaatacgttctgaattttgcacaataattgtacgtatcactgttgtttgcaaatccgactaagtacccttcacttttcttacctgtttcgcccgtatcacctgtcttgtccgtaccgcatcctgtcattaccgtcatacatgccataattcccgccaccatcactgctaattttttcttcattgttttttcctccttaatttttatttatttactttttttattttcttttgtcttaatatcaataatcactgccactgcgattagcacccccttcacaatcaactgatactgggtggatacatgcagcagattcaatatgttgttgatcaatcctacgatgaccgaaccgatcaaggctcctgttaccgttccgattcctcctaagaagctagtcccgcccacaatcaccgcagtaatagcatcaaactcatacccttctcccacagaaggcattcccgccatcaaacgcgccatcagcactacacctgccagtcctgtcagtgcaccgctcagtgtaaatatcagcctctttatgcgcttcgtattaatgcccgaggcaattgccgccttctcacttcctccgatagcataaatataagttccgaatgttgtctttttcatcaatatcgctatgactacaaccatagcaagcataatgataaccggaaccggtattccgaggactgccccatatcccaatggtctcgctttctgcacgcctccgattgtctgcccgtttgtataaatctgaacaattccctgaagtacataggtcatagccagagtcgcaataaacggctgtagtttatagtgggtaattaaaaatccgttcacccagccgcaaagacatccgattgcgatacccgccagtatcgccagcggtagatttcccgttcccgcaaggattcccgccgaaatgcacgctgatgttgtacacaaaaatcccgctgacaagtcaatcatgcctgatacgataagcatcgtctcgccgcaggcaataatggtaacaacagaaatctgttttaatatgttaatcaaattctggggttttaaaaagttatgattaatgactgccgatgcaataaataaaaaaaacatgataagtacgattccgtattttctgtatatctctcccgatgataatctcttcttatttttcatctttcgcctccacaattattttcataattttatcctgaaccagatcctcacgctctaaaatttttaacaatttcccgtcaccgaccactcctactctatggctcatggaaagcacttccggcatatcagaggagatgagtataattgccataccctgcctcgcaaactctgtaatgagggaatagatttcttcctttgcacctacatcaatccctcttgtcggctcatctaaaataagaagcttaatatcccgcacaagccattttgccaatactaccttctgctggtttccgccgcttaaattctctgcaagtgtactcatacccggagctttcactgaaagttccgaacaaatagcatttccctttttctttacctgctttacattccagaaacctattctcgcaaacaaatccccattcggaagtttgatattgtcttctatcgatctcacacccacaaatccgtaagtccttctgtcctccgtcaccattgcaatcccatgccgtattgcatttttgacagagcgtatctttacctcttttccctccatcaggatctctcctttttccagatgatccaatccgaatattgtctgaacaatctcacttctccctgcgcctaccatacctgcaaggccgaaaatctctccttcatgaacccggaacgaaatgtctcgaaataccccgtcattagtcaaattcttcacttcaagcacaattcgatccttatgttctgaaattgggggatagatatcttcgatatccctccctaccatcatagatataagctgctcttccgtagtgtcttttatttcccccgatgcaatccacttaccgtcgcgcaaaactgtatattcatcgcagagtgcgaagacttcttccagcctgtgagagataaaaacgaatgcaatcccagtctctttcagtttgcatactgtcttaaaaagaatgccggtctccgcacttgtcagagatgatgtcggctcatccattataatgactttactgtttctcgaaattgctttcagaatttcaatcatctgacactgagccacattcagatttcccattttttcatcggggtcataatccaggttcattatttttaataattcctttgtttgcttctttctctcctttttgttcaaaaataattttccttttttctgttctctccctaaaaacaagttctctgatatcgtcagctcaggtacatagttcaattcctgtgcaacaatagaaattccttgtgcataggcatccttctctgacttcatatgaatctctgttccttcacaaaagactgttccaccataaccggtataagttcccgacaatatcttcatcagtgttgacttgccggctccgttttcaccgaccagtgcatgaactgtggaagagcgtatcttcatattgacctgatccaatgcgactacacccggaaactctttgcgtatgttttttagttccacaattgtacgcctcaccaaaatgttctctcctccttgtctaaacgttttaacatttattttttccaatccttttttgtacgttagaattatatcatatttatcatgtttattcaattaattaggtttatttttgtttattttgtatattatcacttgtctaaacgtttcaacaaatatgtctaaacgtttcaacactgttaaaaatagacagacacaaatggtattattttacagaataaaagagccggtttcaccgactcttacataaaaccattttaaattttctttgtactgccccgaagcaaaagttgtggtttatactctctcacattccttccctttttttctgtgcactcgatcagctccatggtgcgttctcctatatactttcccatttcctctaccggaatgcctattgttgtcagcggcacctgcatcacatccgcaaacggaacgttgtcgaaaccgaccacagaaacatcttctgggataccaaccccgtacattctcgccgcacgataaataccaaatgccatctcgtcattcatagagaaaatagccgtcaccttttttcccataatatagggaaataacatgtatccgctattcattgtataatccccatagacaaccagttcttcatcgtaagaaattccagcttcctcaagcgccattttatatccttccaaacgctcctgtgtcacctgatagttctttttccccgccacacaaccgatccttctgtgtccgtactctatgagatgcttcgtcgcgatatatccgccctgacggtaatcaaacactacatccgtcccctcacaggcaaatccgtaattatccatagtcattaccggaacatctagctgcaacatggcatcattcagtttctttttttcttcatccgtatatttctcaagcgatttcgcccagatcaaggcactgatatttcccgcacccacgttccgaatcagatcacactccaccgctccgtcatcttcgataatatggcagacaagagagtagcctcttttttcaaacacattgttaatctccatgaaaagtgatgaaatatgggtgttccgcaagtcgttaaagacaatccctatcagcttactctttttattcacaaggcttaccgctgcattattcggctgataattatactttcgtgcaacttctattacttttgcttttgttttctccgacaccctagttttctttgaagacagtgccatagacaccgtagccaccgagactccacactcacgtgcaatatcctttatcgtcacctgcatcactgttcctccgatatatcttccactctatttctatccgcgtttctgtatatcttactattgtaaagcaaatcataatatctgacaaggaatttcccctgtactttcttgtctggattttaaatttatttgcttcagccaccctaattgcttctgcataccagcaaatttgggccgtgttctttcttaaaagaacacggcctaaaatgggcaaggggtgtcccaaactcagacagctctgctccctattatcccttcttttccgttatcccccatccggcattgccaatgcagcgcatgacctgtcccgatggatccacaattgcagcatcgcaaaaagcggtcctgataacccttgccgctgttcatcaggggttcgttcttgatcttttttatgtttattatatcatgaacaaaactgtagccaaggtgtaaatatttacacaaatgcagtatataaatttacaaatcatacattataccagatttggttttgaattatttgcttatttctgataaagcgccatcaatttctccactgctttcaataacacaagcctcatagttccatatatttctttaatgcctcatataaaattgctggttcaatgggtttggtcagatgcatgttcataccagactcttttgacttttttctatcctcatcataggcattcgcagtcatagcaatgatcggaaccgtctttgcatcggcacggttcagcatacgaattgccttcgctgcctctaatccatccagtataggcatacgtatatccatcaaaacggcatcaaatgcccccaccggtgagtcctcaaacgcttgcactcctttttgtccgttgtccatccaatacaccgtgcagcccaccctctccaacagtgtttgggctattttagcattaagcggatgatcctccaccaaaaggacttgttttcccgaaagcttttccgctgtatcagtacgttcgttctggtcgtttgtcagcgatttcagcgctttttctgagtctacttgttcaaaatccaagtaaacagacatagtagtccctctgccaagtgcactctctacttcgatacgcccccccatcatctctaacaaattacgcgtgatagaaagtccgagtccggatcctgcatattgggaagaaaccatattctgctcttgttcgaatggtgtgaacaaccgggttttcacaaactcttcactcatcccaatcccatggtcaataatcttaatgcagttatgagaaatcatcccttctcttgcaagatattgtatatccatgattatcgaaccgcctgccggagtaaattttaccgcattagacaatagattgacgaatatctgtttgatacgtacaggatccagatacacataccaatccagatctgcattgtggttgacgatttgaaagtcgatcttctttttctccacagatggtttgatcaaagcaactatactttcatataaagttttaatatatacaatttgtttgttaagctgcatctttccacgttcgatgcgctggaagtccaacgtgtcattaatgaggctcagtaaatatataccagattctttcattctggcaatatagtcctttaatatgttcggatcattctcctgggacgaaagctccgccaagccaagaattccgttcataggcgtccgcatatcatggctcattcgggaaagaaattccgatttggaatgacttgcctcttccgcggcatgaagcgcccgggccagtgcttctttttgcttttcttcctgctcgtaggtatcagaaacatcctgaaccgcacaaagaattgtgtcccggctgttctcaagataagtgtacatgatgcgcttatataccggcttatcaccggttcgtttgacataaagactatcataaactgccattttttcaagttgctgtttgatgtactgcaggctgttttcacggccagtccggtctgcattttccgtattctcaaagacatcaaggccagcctgtatttctgtgaacgcctttaaatgtgcttctttcatcccgtttttaaatggctggacagcccctgtttttgcatcaacagtcatgatgatctgataatccacatcaagaagacgatttactacaagctctgcccgtaccatatctgtaatgtcccgcaaaaccgaggctgcctccacatcgccggtataagggtttacaagcatatcaaaactgctttgcacccatcgggaatcatgtttgagatgatggcggatttcaatatgtgttgtaccattttcaaacgcccgcagcatggttttgcaatcatagacgggtaagaatcgtttttcctcttcagcatcggcggaacattcccgaataccacgcagaacatcatccaccgtcgtacacgacatgattctatatagctctggattagagctctctgcctcagtcattcgattctgcgtaagattatagcttgccattgcaagcgcttcctgagctgcgaccttccgaagccgcagctgctcctcatagttttgttcgcgctccttttgttccgtgatattaacggcagtgccaatacactctttacacataccatttttatcaaaaacaggtgtataaatcacacgctgccatatatattttgagccatccggcgacttacaacgtatatctttttgaatccgccttccttcgccgcaatgggcaaacagccacgcaaagtcctctacgctgtcctgatggattaagccatcccgtcctgcatcaagaaacacgtccgggatattctcaattacctttggccagccataatttgtgccgaacgcgccggaatctgttacaattttacgtttaaaatcataacgccattccataacctgggcactagccagtgcggcattaagcatcgtgcggttgttttgcagctcctgctgcgtacgcatcatctcatcacaatcactaaaagctgcatataccttgataaaattttcgcggcgctcaaccgcacaggccgtcaggttcagccatttccattggccatcgccacatttggcacgatacagagcatttactttatcctctccagctttcaacctcaggatagcggattctataattttgcggtccttcggatggacagcctccaaggaatttgtccctaaaaattgtttgcgcgcagccggctccgcaccgagcatattataataggccgcatttaaattgagaagagacgcttggccgcctttgatttcatagataccgatcccggcaggcacctcatccagcaagttattcaacagaaacattcgttcctgttcttcgttgatgtctataagaacgccaatcgtcctggttggtgtaccttctgtatctccatagaaaaaggctatcatacggcaccaatgaaacgtaccatttttcatttttaggcgtaaagtcacctctacacgttcattactgctgcctgatgaagtttctgcgaaaaaacgctgcaactcagcacggtcatccggatgcacaatatctgccggaccgcggttgttcaggatatcctcattgctgacatcactgattgcataattttggtatgcctccgagctataaaaactgccgtcctttaaattccattcaaacacagcagcgttaagttcactgataacggttcggaatctgctttgttccaacgccgtattcaactccgcttccttttcctttgtcacatctgtaacaatagacacaataagaaacgtgtccggcgaatcctgtttaattgcagcaaaacgccgattcagccatagtgtttttccatctgggcggagatagcggtgggtaatatctgcaggctttccactcgaaagcgctgttcgggctgcagcccatattctctgacaatcagtctccgataccgcagcactgataaacgcttccatctccgcctgatattgtacgcgttcaactcctacattatgaaaaaaagcatcgttggcatagataagttcttttttgttgtctataattttaatcagggacatactgcttccggcattttctgcaatcagagataattgcgaggcaacttccttttcgcctgtaatatccgtaaaagaggtaaaggcaaactcctgcccgccaaaattaaccttggaaacattcagcttcacccatcggatttggccgtctttgcgtacgatcctgtattcatagcccgtggcttctccctcttggtcaaagacaaatttgctctgacgtgtaacaggtgtatcctgcgggaacatcagcgcgtcaaaatctgttttgataggctggtattcctcctctgtatatccgatcagcttataatacgccttatttaaaaaaataggttcagaggtttctaaatcatacagacctatcccacagggtgccaaatcacctattatcttcatttgctctaaaacttctgtattttcacttttcatcactgttggcctcttttccagatctattgtactcgctcttcttcaactccgatgctgcaaaggtaatccccaattctcagtacaatattattgccgctttgtattatttatcttttgtcaaatccgcaattttattgccatatctatagttgttttgtgagaaaatcattaaatcacagcttttatctttactttattacattataaaggcaatccttcttttttgcaacatgtttacttttagtgtcaacttgagttttagtcaattttattgccaattttcattgctgtttttactttttcttgttatactatttccaggaggtattgcatatggaattttcagaaaaactatcggcgttgttatcccttaccgccacaaaaaatgtaatgctggcccgtgctctggagatagataccgcacagatcagccgtctgaaaaaaggaacccgaaaaatgccagcgaaactctccctggtacaaggcatagccggttattttgccggccggtttgacagcgagtatcgcctctccgcactatatgagctgacaggagacgtacgcttgcatacaaatttagatgaatcgacccttacaaaggtcatctacgaatggctgattgcaccaaactctgctcctaaaagtcaaataagccgtttcctcgaccgtttcggcactttctccatggaggatatcaaaacaattgcgtccgaacccgaaacgaaaccactcacactcgaggaaacaggattcgttgcctactacaataatgaaggaaaaaggcaagccgtacgtgagcttgccgcttatgttctctctcttaataccccctgcactatacgcgtattcacagacgagtgtatggattggattattgaagacaacagcttcacgcgggaattagctggattgatcagccagtgcgtgaaaaagggctgtaagttccagcgcattcagccgcccgcacaaaattcagaaagtattttcaggtctattgaacgctggctccctgcctattttgccaatgcgctcaagctgttttactacccctggtcacgggatgatttgcatcgccgtacgatctttgtagtacccggccatattgctctgcattccgattcactcagcggccaaaaagaaacccccatgaccatcctgaccactgacctcatgacggtacggcttacggacgaacactatagcagaatcttagagcgctgtcatcccgcaatggccgttcatactgtagacacagccattaaacccgctgaccggtacgagaggatatccgccgtagaagataccgctatctgtaaacccggcatgctttccattcttgcaatcccgccggatttgattactcagattcgcaggcgcggcacagcaaccgtacagagaatgtttgaagactatacgaaaaatgcacaggctcgggcccaggtattggaaaataaagtaataacggatatcctctgtctgccggatctggatgaggtattaaagaacactgtaccaattccgggcacgaaaatttccccaactgattggctctactatacgccggaggagtatcagatgcatttggaatacatcttatggtatatggatacctatcccaactatcatgtgatactcttggacaaaccgctatttgataatgtaactgtgtacgtaaaaggaaactgcttcgctttattgattcgtgagaacgatccttttgcattgtttgaagttacagagcaggctttgatcgcttcgctgcatgaacatctgtggcgtcttatcaaagaaacctctcatatcgattcccgccaaacagtggccaagcgcctgcgcagtgaattaaaacagctgaaaaaagcaatgaaaaaaaactgatttatagatatgtgatcaaaaaagaagaaatgggtgtatctatagtttcgctcaaatatcgaaggttagtccgcaagcctaaagcttgcggactaacctccggtttacctcctcaacaacaacctgtaccaggcggtccacgtccattttctcgttataacatgtattcgcggctttcctttcactgccaaacagcttcatctttttcattgattcctgcttaaccgcctccaccgctgctggaatcaggtcaataatccctttattcatatcactgaattttttaaattccgcctctaccgcagcgatattgatatccgtaaaaatattcaccttactgatgccctccgaaacagcctgtttgaagtcagagtccgtaaggccggagcccccatgcagtacaagagggacatccacggtgtttgcaatagtccgaattctctcaaaatctaattttggcggcagcttgtatgctccatgtgcatttcctaccgcgatcgccaatgcatctacttttgtcttttccacataatccttcgccatcttcggttccgtataaaactgcttcggatcaatcatatgagagttaccttctgcagagccttcattatctcctacatgaccaagctccccttcgattgttgcgccgtaagagtgggcaatatctgccatttcccttactttttttacattctcctcatagggatctgtagaacagtcatacataatggaagaaaaccctaattcaagtgctttcaggcaagtttccttatgaaggccgtgatccaaatggatgacaaccggcacatttgccttcttcgccataggaatcaggtaatatgacacctcctccagcggtccgtatggaaacagtacttccgcagtgcccatgattacaggcgaagccgtactttccgctgcacttataattcctcttgcaagttccagatttaccgcattgaaaagtcctactgcataatgattttttttcgcaggaatcaatacttcatttaaatttactaccatattccgcctcctaatttttattagatcattttatgaccctattttgtgccatccggcatttattttctgttccagttcgtcaaaagtctgcaatccgctcaaagcatcataggccgccacgcaggaagccccggttgccgtcgacagctgcagcgttttctccagcggatatccttccagcatggcagtcaaaaatgcagcgatgctcgtatccccggccccggtaccggaaaggatacactccggcacataactcttttcaaacccttctttgtctgcccagctgtttaaatccagccccacccggtttccaatattcaggagtgccctccggcccgcggttttataatacatcccaggcgcgccacatttgatcagaaggactttggcaccgaattccatgcattgtcttcccaggggttttatatctttttcgatgtccagaacctctgtgatgtccttccccgaagccctttcctgccattgttcgtaacgtttcttatccagcataaaacaaagttcttccacgctgggcacaaaaaagtccacaaaaggcatgacacattccagaatcttctcccagtcagccctgccggcttgcgcatcaggatctacagccgccatatcaagtgaagttgctgcacccgccgcttttgcacgtttcattatttccaccaattccgctccgtcattttcatacatagatctcatcagcggaggataaccaaaatgaaacaacgccgcttcctctaaagctttctgaggaatgtccgatgcccggaaggaatggtttgctcctgaattatgaagaaagatgcggtcaattcccggaactgccaggattaccgtataggatgtagattccttgtctgataaaatcattcccgcctctgcatcatatttctttaaaatattatataccatatcgccaaatgcatcttttccgatcttccccatcaaagtaacatccgcaccgagtatcttcattgccagtccggtgttggctacggccccgccagtgtgtacgtccgcctgccccatctgtatcagactgcccggagagagtgtctcgcttaactgctttacctttttatcagggaataccggcgtgatatccagacaaatatgtccggctgcgattacttttttcttcatagctgcctcctgtctttctttttctaatacggaaaatgggagaccttttgatctccctgttttttgtgtcaagacttattagattcccatcagaagattcatcacatacatttccagcgcctcaaaatctctgttatcaacacattttttctggaaatcataatcgaacttatccaccttttcttccagagccttaaatatcttcaggctattttccagatgcttatagctgtcctcatcctttgtcgtcctcatcgccttgacatcgagaccgacatactctccgttctccccataaccattttccttcaggaccttgacctgattgaatgcagcgcgcagattctcgacgccaaatgatttgtcctggtcataacggattccgttctggtcattcagatgcacggtcatcagttttcccattgccatcgcaaatccaatctcattggccggatccagccctgccagaattgcgtgtgcactctccagattaccgcctacacgagccggatctatcgtagccgcagaaacagccatgacatgtcccattgttccgcagatgcttctgtcaatcggctcatttggcttcggctcgatgcagacacggatcttcgggtcatattccagcatcttattaattgcctccaccagcatctttgttgcccagaccggagattttgactctgcacacagcgttccctctcttgcaagccagagcacaatcatatcacagccaagttcgttggcgatatctatcgagcggtaagccctccacatcgcatactctctgtctttttcagatgtgctcatgaatccgccgtcctgcgtgtgatcatccatccagaggcgcggagcgacaaattctgccttcagatcgtatttgtccagtgttttcttcagttcgcgcgccttctctttgatttcctcttccgtgtaatcattgatgttcggcactgcatcgtcatcgtggaactgcactgcggaaaaccccagttctgcaaaccttttgtacttctcctctgccggaatgtcccttcttgttgccggaccataagaatctgctcccgtatgtacattccagggaccaactgaaaatttgaatttcgtcataataatttttcctcgctttcataaaaatgggctttggcgctattataagtgctaattatgggaatgccgcaggcccttaactgctatatcttatttatatcagagacagcaggctggaaaatgactatgttgcgattttttttgttgtttattgttttcacgtggtgtatcataaagccagagcccccgcagtgagcagcggagtatttgtcacttacctgcccgccgcctgcatagacaggaatcttatctactttattgataaaatgtatttcaaggagaatgaagacatgttaaaaaaagaggaatttgaaatcgtacagcatacaacgatgaactatctggaaatctttctggtagaaatgactgcccgcagtcctcacgggcacggagacctggaaatcggcattcttctggatgggagccttacacttttcacagagtttaaacagcatgaactgcatgccggggatatttatattatcaacaggtatcagatacattctttttttaatcatggcagtcagaaccaaatacttgcgtttcagattcatcccgacttttaccgcagaattgattatcagctcggtttccttcgtttcgataacaatatcatccgaaacggtgaactgcatgacgctctgtaccagactttgctgtcctgtgctgcttcctatttttcttcttccgcgcacaatgccatcaaatgctccagcctgcttctggaagccatttaccagctgctgacaagaacgaagtatacaattgcgagtgaaaaagaatccgccaccgccaaaaacaactccaagcgcctgaaccggatcacagactacatctcagaacactatatggaacatattgccctgcaggatatcgccggcctggagaatatcaccacctatcatgcttcgcatttcatcacgcagatgctggggatttcctttcaggaatatctgaataatatccggttcgagcacgccttccagttaatctcaaaatccgatctgccaattctggacgtctgccttgagacaggattctccagcagcaggtacctcaatcagatgttcatgagaaaccttgggtgcagtgtaaaagagtatcgaaaaaagctggaaaagccgcgcccggttggcgcagctctccctactgacaatatacagaaccggtattcatttgaacaggcggcttttgttctgtcccgcatatggaatacgtgtaaactgtaaatggctttatgaatcctcaaacttttcccgtatgtattcatatttgcgctccattgggctgtgctgagacccggggcgcaatgcctccctaccccacctcataaaccgctgtcccaaaagccggaataacctgccgtccctcctgccattctcccgtatacaatagcggcatcttctgctttagttcaaccacagcttcctctgcgcaaaagttcaaaacaaacaggaaacttctgccatccttcctgcgcatgataagctccacatcctcccctgcgtttaccagttcagcaaatggttccgagacattcgtatattccagcagcatttttacattttcccgtgaaaaagcacttccaagatgcaatacttttccgtttcccacatggtgttctatgaaagccgcttttcccgcataataactgtttttgtaagcagcaagcactttgccgccggcaggctccataatatcgttaaatacaggcatctccatttcacggccattccaatctgcatagaccggtacctccgcaggacttgtaaaggtatattcttttatatcagaacctgtcagctttgcaaaaagccccggctgcggttccatcacacatcttccattcatgtccttatacccggccctgcagccgataatcagcgtaccgccctgttccacataaagcttcaataattccacacgcctcttattcgcgataaccggatgcggatagaataaaaccggataccgtttcagctcatccagttcgctgccgtgctgcagataaacaacatcataaggggtatgggacttttctgctgcagcaaaaatttcattttcactatacttgccgattctttcatgccatacgtccacttctgcgtccagtacattatcgtaatcctttaaaacagcaaaaccagccacataatctgccccgcatagaggttccagtgtctgaagttttttataaaaatcctttacttccgccagtttccgattatccctgttatcataatctaagattccatgccagtacatttcggttccaaacgtgcaggtacgccaccgaaaaaatgatataaaatccgcgccatgtgccacactctgcattgcccagagcgtcagctgccccgggtgcggagccggcccttccatccgggttgtccagccgttggccccagcctgctgctccataattccaaaatgcgggcagactgaccgcacttctgtcagatgcttagaccacttcctgtcattcaggtcctgtgatttcagcggttcccggtccaatccataagcaaaactggggtaagaatcatacatatatacatccaggcattcttccatcatccgatggttatccacatggtcgaacattccgttcgtcataacaaaatcttccggctttttatacttacggatgatctccgcctgcatgctgcaaaaggaaagtgtactgtgggaaataaaccggtaataatccagatgcatatgtgggttcacagctctgctcagtgttggccgcggcacataaatctgttcccattgtgtataggtctgattccagaatacagttccccatgcttcattcaaagcatccagtgtcttatatttctccttcagaaatacacggaatgcttcagaatccgcatcggaatagaattcggaaacctcacagttcagctcattgtcaatctgccatcccacaatcgccggatgcccgccataatgtgccgcaatttccgttaccactcttgctgacagttccctgtataccggcgcattataattataatgccttctgccgccatggcggtacaaaacgccctccatgctgctgttcagtacttccggatatttttccgtcagccatgccggcggcgttgctgtgggggttccaaatatgactttcattcccttcccctggcacagttctaaaaaatcatcaaaaaatgtaaacgtaaagcgtccttcctccggttcaaatttattccacgcaaactccgcaatacgaattactgtaatcccgatatccagcatccgtgttaaatccgcttcccacagcgctttatcccagtgctcgggataatagcacactcccattgtcattttgttccattgaaaattctgctttttcttcataactccacttctccgtttcctgcataagttgcccgttattaattttacgatgtactggtatagtagttttttcccaagaacatgaactgcggcatgccctcagggtttgagaaacaaaatttcttctccctatctattttacagaatcgtaaacggagcgaaaagagagaaatccgaacatttataaataaatgggcatgtcagaaatcccggacttctgacatgcctgttttatactgctccggtactgaaggatccgaagaatacggttacagatgtggcctaccagttgaacttttcctcaagtaatcctttttcttcggtgtttagaaagtatatgggatgcacgcctacctatttccgagccggatatttctctgcattcttttctgctttgtcttccaccgcccgtgccagatcgatgtcaaagtgtttacatatccggcagagataccagaagacatcggcgatctcttcctgcagatgttcaaattcccggggttcttcctttacactgtccgcttcatcagaatgaagccacataaatatttccgcaagttctgctgcctcaacggtgagagccatcacaagatccttagcgttctgatctttacgccagccccgggcgtctgaaaactcctgaatatactccttaatctccgccaatgttgtaactttgtctttcatttatataatcctcatttctcatataatcttgtaattcagtgtctactcaccttcatacaccacatccaacttctaaatataagcatatcaccggccgccacatctggcaatccgtctctagtacatcgtaaaataaccagctgattcataagctgagacacatttttgagagtgctgctccgcaaacacaagcgtagtgggctgcgctgaggcttgtggagcagtgctatcggaaatttaagccggcttatgcggcagttaattattatacaattactagtttcacattttactctttttttaggaaccaatcacattcccgacatattttgccgttatactcaaaaacaaccatagagaaaaggaaggatttactatgtccagagcaatcggtattgatttaggaactacgaacagctgtgttgcagcaatcgaaggcggtaagcccgtggtgatcgccaatgcggaaggtatgcgaaccactccgtccatcgtcgcttttaagaatgacggcgaacgccttgtcggagaaagcgccaaaaggcagtatgcgctgaatcccacaagaaccatttcttccattaaacgccacatgggtacggactaccgtgcccgcattgacggaaaggattattcccctcaggagatctcctccatcatattaatgaagctaaaaaaagacgcagagcaatatctcggccagcccgttacggatgcagtcattacggcgcctgcctatttcagtgattcccagcgccaggcaaccaaggatgcaggaaggatagcgggcctgaacgtactgcgtattatcaatgaaccaacctctgctgcccttgcatatgggcttgataacggggagcctcagaagattatgatatacgatttcggcggcggaacattcgatgtttctattattgaaatcggaaaccaggtcatcgaagtgcttgccaccaatggggataatcacctgggcggcgatgattttgaccagcgcctgacagactatatcgttaagacctataaaaagcaggaacggattaatctggaaaaagatttttctgcgcttcaaagagtccgggaggaatctgcaagagcaaaaatcagcctttcttctgcggcacagacagatatcaatctgccgtttatcacaacagataagaagggcgagccaaaacatctgcagatgaccattacccgcgcacagtttgaggagctgaccagcgacctggtggagcggacagcaggcccggtgaataccgccctgaaagatgccggcattcgtgcagccgacctcagtaaggtcattatggtgggaggctccacacggattcccgcagtccagaataaagtaaagcagctgacaggccttgagccctcgaagtccctgaacccggacgaatgtgttgccctgggagcggcagtccaggcagaaaagctcagcgggggcgcggcactggcagcaggctcttccgcttcggaaattattctcatggatgtcacaccgctctctctttccattgaaacagtgggaggcgtggcaaatgtactgattcctaagaattcggctattcccacaaggaaaagcaacatttatacaaccgccgctaactttcagacttctgtagatgttaaaatctatcagggtgagcgtaaatttacacgcgacaataagctgctcggcaattttaaactatcggggatcaagcgtgcccctgccggagttccacagattgaagtcacctttgatattgatgcaaatggaatcgtcaacgtgtctgctaaagacctgggtaccggcaaacaacagcagattacaatcacgtccagctccaatctgtccgaggctgagatacagaaggccatggccgacgccagattttatgagagccaggacaacaaacgtcaggaaaacattgatatccgtaacgaagcggaaaagcttgcattccaggtaagccaaagcctgaaagattctaaaaaagatatggagaagaccgagtacaaacagatcaaagccgacctgaatactcttcagaaactgcttggaaagacaaccattgaaaaaattaccgatcagcaggccggagaaatcagggccgccagggaaactttggagagatcagcggcggagctgctttcctaaagcccaagcagattttcttttccgggtagggatgggcagaagggggtcgcgaaaagaagggatctccgcaagccgtccaagtgcacatatgccgttgcaaaatgcggacatggacggcttgcggagatcccttcctttcactggttgcatccaatcggtagtaacggtcgtcagctgggaaggctccttgatgtggacagtgtatggattcgcttggtggtacagcttaatccagaatcagatcaggattgtctgaaaagtgtttcagtataacaattgggtctgtttctgatgggtttacgatctttacgccttcttttgctgccttttcggtcacaaagtactcatcgtgggtaagctgaccatagcggatcaacgcgggggattctatctcccacacgccaaatgttccatgcccttccaggcagatcaggccgtatggtgcgctgtcttttatgaagactgtacgcccgggcagtactgtcaaacgttttgcgctgacacagtcacatttatagcagatccactcctctatatatccatcctgcagcatttcttccataggacgtactggtttgggcctcatataattatgcttatgaaaatcagggtcgatattcttttcccagtcaatgacatccagaagatactcataattccccttttcttcttccggacagttcttccagagcaggtcttcgcctaccacctgtccgttcagcagtacggactgatacatggcatagacatctgatgcaaactgtggttcatatgtacacagtgagcccggtgcatgcataactcccgggtctacatggaaaccggtatcgtgttccagcttatatgctctggagaggccgagaatgttgttatcacccttcttaaagtttctgaggctttccaagacctcctctttcgtggtttccggattaaatccgaaaaatgtgaaggggaactctcctccatggttattcagctgggatgggaaaaagtacatttcgggtttaccgtctgcccccactctttctgcgtgtgcctggcggtgatggatatgatgaggcagaggcccggcattgtcaaagaatttagaaaacatagcccatcgatggtacttattccacagcttctctccgatcagctctgcgcctgacagttcaactgcgtcccgcaggagaatccgctcgttcccctcttcgtcagctataatatagcttaacccttcatcctccggagttcccggcccattttccgcccatgtcgtggaagaaaaccaccgttcatcaattccgccccgcgtgcccaatatatagtaatcatcggggtgcagtttaattctcttccccggacggcagaatgctctgggtacccaggccggcgccaggcggagcactccttttccctttgacaaagctttttctgtcagaccttttttgtccataatagcctccttactcattttatcgaaaactctttacgaggtactagtataagccacactaaatgccttgctggtttatactagatgagtttagactatcacgccagaaaacgttcgtcaattcaaaataatattttcggcttaatacacattttatgacgcaattcatcgtgttttagcacaaaaaaggagcgaacaccagaaaacattcttcgttttgttcgctctggttatcgatgccggcacttaccatccgaataattcccactcgctcgctgccagtttattcgtagatcttcgaacaatcagattacagggcagttctacgcttttttcttttatatccgggtctgccagcatttttaccgccatacggcccatttgatacgtgggaacattaaccgttgtcaaagacggctctatcattgacgatacgctcagattatcaatcccggtcacagcaaactcatccggaatcgtccgcccctccgaccggaccgccttaattgctcctatcgccatctggtcgttcgctgcaaatatagcagtcaggccccggttcctgatcatcagctccttcgccatcatatatccgctgtttggcgtaaaatcgccctctgcaatcagatccaccgaatagggcacgccgaattctgccaaagctctcttgtatccctggaccctgcatattgtaagaggattagacatcttgcctgaaatgtgggcgacacgccggtgtccgttttccaacagttcccgggtcgccatatatgcattcttctcatgatttacatacacacttccgaaccctgtttcctccagttttctctccagagttacaaccgggatcctccgttccagaaacgtctgttttataaaactgaaatattccttttcttctgtagccgggcagacagtatcaataagaattccgcacagcgcctgcttccggatcgttttgatgaaccttttttccttattaaaatcgaaatccgagttgccaactaccaggacatatccctcttctgccaccgtgtcttcgattccgttcaggagattagaaaaaaatgtgcttgcaatattcggaagaacaaccgcaataatcttatctctttttttctgcctttccggaagctgataccccagctcaccagctgtttcaagcaccctgctccggatctcttcactcacatattttccgctgtcacttaagaccgctgaaaccgtagataaagatacgccggcagcctttgccacatctctcataccaggcatctccgcaacctccctgatctgtgttttatactatggtactccggcagcgaacgtttgtcaattcattttccttttatttagattcctttcccaccgaagcctccggctcacgctggaaatccccaacctaagagactacatgaacattgtattattctccattggggactgctgatgcagccccctgttttctggtcagccctgagactacaagatacccatctgcatatttcccggctgcctccgccagtttctgcacctctttttcttccatcagttcagttgtgtcataatcccattcctgtccaatcttagcatatttctctttacacacattattaaatgcacataattcccagcgttctgtcacatccgccagttctttccgaacaaacaggccgatttcctctatattttcttttgctgctgtcgcccccggaattaacggcgtcctgatccacagccttgtgtccctctttttccgaattttaccggctatgaacttcaggttatccaatatgatcttgttgctgacgcccgtatattctctatgcagtttttcatccatgaatttgatatcatagagaaatgtatccacatatggatatatctcctcgtaaacctctttcttaccgaaaccagatgtatccagtgcggtatccacaccctgacgcttcagcgcctccagaaattcagccagaaaccggtgctggagcacaggttcgccgcccgacacggtcacccctcctgaaaaatcgtcaaaaaacatatcgtctttacatgcctctttcacaagccgggctgtttcccagtattctcccaccgtgcccatcgcttttgccgggcactggtcagcacaggtgaaacattgtctgcaggctgttctgtcgatccgtatcccaccggtctccgcagccagcgcatttcccgtacagtgggcggcgcagctcatacagccgatacatttttttgcatcccactgcagctccctgtccggactgatactttccggattctggcaccacctgcagtgcagggggcaccccttcaaaaacacagtggtgcgcataccaggcccatcgtgggttgttcctctgtgtatgtcaaaaaccagtcccttttccatctttcttccccgctaaacacttgtataatttactctgttcacaaattcttttctgaactcgtgatccataaccacaaaatgagcgctgtacccggtgacctttacgacaatgtccgcatattccgggttctcgatatcgtctaccgccctcttaagctttttcagatcgattacattaaagttaatctgaatgccgcccttcttcatgtatgccttagaaaagttttcgatatatgcgcctttgttttcctttccgtcaaagaatttcggctgcagttcgatctgcagcgaaccgccctggtactctctgaaaggcaccttcagtaaggactttgcggttgcagtgatcccctcatggtttcttccatgcataggattgcacccatgcgcgatcggttcctcggcaaacctgccgtccggcgtcgcgcccagtataggaccggcataggtatgccccatatattggaataaagaggcccggaagttgaagcctttgatattgcgctgttcctccagcgtatcgtggatattttccgctactcttacgtacatctcgtccacaccgtcccggtcgttcccgaatttctcctggttcagcatgatctggcgcatgatttcgtgatctttccagttgttctgaacagccttattcagctgggccatcgtatatttcttttcctcgaacaccactttctttatggcgtacagagaatccaccacattgggcactcccagaacattaacagaagtaaatgcattatgaggcccgcctattgacgtaacatccagccctttttcaatggtgtctttcatgcagagggtagtgaccatttccggccatacccggtcctgccacttatacacacagttcttaaattcggtaaatgcttctgccgtccgctttacttcccgggtatataaatcccaaaactcctcaaaagtttctgcattctgttcttctgccagcttcatggctctctgcatgggggccggcagaacaaaagagttcaggtcatggtcgctgtactcggctcccaccgcgcagtaccactgacagccgctgtacgacacattccaggcatcgtcttcgctgtaaccactgtacagctcggaatcccgcattacatcatagttgaccagagtaggaaccccgcagccgtgtcttgtcaccacgtcacatgcatagctgtagtagtccggatccatatcttcatgccacatcacacccagatgattatagccgcctatcatatcgtaggcctccagtccgatccagctgatttcattggtggcgtcccggccttcccggtctcttccgccgaaggagaaataattcccgccgtatttcaggtacagttctgccaggatatctctggcttcctcccttgtgattttcccttcttccagatcctttctataaaatctgatcagcatctggtccagccttccatatccgttgccatggccgtttatcctctctacaacctggaataactggatccactgtactgcctgctcaaaactctcaggcgccccctctgccagctgtttcatattggcagcaattttctgatacctcttcttttgttccgggtcgccctccgcccctgcaagttccgcagcacgcagggaatgccgcatagtatagcgtatgattgcctgtaccacttgttcctgtgcctccagataggcgcgcctctttttgtttccataccgtttccatttttctttgctttccgtcacatctttcagcagtccggtccatcccttctttaggccgatgttaagatccgggcaggtatgtgccaggcttgttcctccggcgcccatctggcgcaggtcaaatcccagctctgccacttcatccggatacacaaactttctggcctcatccagctgccagtggaattctcccacaatcgtctcatttggataaatttctgcaggactatggtccaaaaaaaaagcataatcctccgcccagttagttgcagagtattcgaagcccttcactctggacggcatctcgtccagatacggaaacggagtgcccacatccacccggcagttgtggtcccccagattgattctctcgtcatcggaaagcgccagctctccggttgccggtgagaatcccgcactgtgcccggaccagtggtacacaagaaattctgcgttatccacatatacattccttctcccgctttttgataaaccggtgcttctctcccacaatttttgtattctttcatttttcctaaatttagattgttccattttagtacctccattcatgtttcattttctgtctttattttatcagccaataaaaaagccacaacttcccgttgtgactttaaggttgcatgatacgactatttctgaattaaccagccgttttgttgttttatatcaatccatctcatcccgcagagcgtcgatgatattctcctttttgatctttcctgcggcatataccatggtaataaagactaccaggaacacaccaagtatactggctcccatactgcaccatgggaacacaaatttcatctctccgcccccggcgttcatacccacataaatcagacaggatagaatccctgcgaggggcagcccccaaagcattgtccgcactccgtaaagagaacactcaaaacgcatcatcttattaaaatcccggtcggacatccccaccgaacggagcatggcaaactcccgcctgcgcagcttgatgttcgtggagatcgtgttgaaaacattcgcaaccgctatgagcgaaatcatggttatgaaaacaatcgcaaacaagttgacaatgaacgtcatatttcggttctgatcaagaattccatacacattatacagggtatagtcagcggttatgccggctccgtcaatcatcgcctgcatctcggacgtggaccgtcccggattgtctgacttgaaagtcatccccagttttacaggctttgaagacgcccccagagcgtcaaactgaggttttgcctggtatggagcgatcaccataagcgtgtatccgcgccagtctcccggctctgcgggcagcagatccggataggcatctacaaaggacgcacggattgttttggtttgatctcctgaatcggaacgcagcgtaaattccatgggctcttcctgcatataataatgttccggcagtattcctgtcacgatcatattgtcttccagcccgctatattccgtttcggaaagctccaggcctttgagcaggtcctgatagaccccatcctctacaaactggatatccagcggcgcttcaaccgtttcattcgtcccgtcataaccaataagttccccgaattcatccagaaaatgtctggtcagatctttcgtattaagtacgcaggaataggtcgaaagcgcctgataagaactttcttttactccgctggcatttttcatatcttcataaagccggaggagctcgtcttcttccatgtcccgtgtatagaaacaaatgtcatagtcttcaactgccacagcagaattctctgctatctggttcagataggtaccgaaagaacttgccgtcacggtcagcaccacgcttaacgtaagcgacaggattatgctgcggtaacgccgcttgtttcttttgaagttctttaacgcaagcatcccctccagaccgtaaaggcgttccgtgagctttgaggttctgagcgccctggcttccaccctgacctcgttggtctggcggatacattccatcacaggggtccctgcagccttctttgccggaatataggccgatattaaaatggtaatcaagctgacaacaaccccggctaaaagagcaggaaccgacactttcaaggtcagcggcacattatcatacatcatatttgcaaaattctttgccacaagggaaagcaccagccggatacttggaatcccaattaaaatccccagcggtatgcccacagcaccgatgcatattccctcaaacatgaccgaattgcgcagctgcctttgtgttgcgcccaccgacatgaggattccaaactggtgcgtgcgctcattcaatgagatgttgaatgaattgtagatcaggaatactgagccgagcattaccagggcaattaagattcctccaaccgagtataaaaggactgtaagcaatttttcccctgacagacccataaaccgcagtacgtcatcgttcagaacatagctgtaattatccgggataccgtctgtataggaatgaactttatagggattctttagcgtaacaaatacggaaagactgtccgctgcggctgcatcctccgttgtaattaaagtgtatcccggcgcggcaaactcctcggcagccggccgctggcagatgcccacaaccgtataggtcttctcttgtgccggaaccagtgtttcttccccgccgcagtatggatcgtgctggctgagcttctggccgtctttcatgcggcttcccacctgcagggtgatcgtgctgcccaccggaattttcaccccgccgtttgctgcaatatgcgccggtatcagaacctcgctgctgtccctgggcattcttccggaaagaagctgtagtggcagagtttccagggcttcttcattccacccagaaagaaaaagatagggcttgtcgggattctggcccccttccagcgcggcataaccaatgttctgcagggcagccgtacctgccacccggctgtcgacggcctgagactgtagataggcagaatctgcatccgggatttcaacatgccagccgccatactttgaagcagccccaagaatcatataactctgcagggaaacggcaaatgtagcgacacccgtgatcagggccgcagacagggccacgccgaccaccgttacaaaggtccgcgtgcggctcttttttaatccctgcagggcaaccttgtggaaaatattcatgaccgacccacctgcctctcatcccgcactactttaccgtctgcgatcgtaataatgcgttctgcctgcagagcaatattttcatcgtgggtaacgaggagaagagtctgcccatattttctgttgctttctttcagcaatttgataatctcgtgtccattgcggctgtccaaagcacctgtaggttcgtccgccagcatgactgccggtgcgttcatcagtgcacgtccgatggcaacacgctgctgctgcccgcccgaaagctggttgggaagatgggactttcgctcctgtaatcccagcaggtctaataaatcgttcagccgttttttgttcactctgcgcttatccatcaggatcggcagtgtgatattttctacaacattcagagtgggaatgagattgttgaactggtatatcaatccaacctgcctgcggcggaagatggccagcttctcattgctccctgcatagacatcctgcccgtccagatagatcttaccgctggtgggcgtatccacgccggctatcgcatgcagaagagtggatttgccagatccggaagaaccaataattgcagtaaattcccctttctcaatggtaagcgacacatggtccagcgcgatcacctgattttctcctgcgccataaaccttacataaattttcaacttttaaaaattccattatgtgaatctccttccctttttctactcatataatagaacttcccgcttacatttcagtgactttccggtgagagatccgtcactttggaaaacggatagaaaataccgcgccgccctgaggatgatttttagcggtaatggttccgccctgtcgggtgataatggtcttgcagagtgccagcccgatcccataaccagccgtaccagtattttttccccgatagaacctttcaaacaaaacaggcaggtcttccttatcaaatcctgcaccgctgtcatgaagggtaataccggtaaacaggggcgtatcctcacacataatgtgaatcttcccgtgatctcctgcaccctcgatgcagtttttaagaatattctggattgcttccgacagccagcctgcatcgccccgaatcacgatccccctgggcacgtcaatcttaagctcgatgctgtgcagctctattggaataaaaagtgggcgaagcgcagtgtttatcaggctgtctacctcgatctgcccgttttggaacatcacaacaccggcatccagacgagataatttcagcagtgaactgagcagccaatccatctgtgcaaacaattcctccgtctccctgaggaattgcttcctttcgttttcatccgggctgttctccagcaatgacagaatcagatttgcggatgtaagcggggtgcggagctgatgggcaatgtcggccagtgaatctgccagatgtcctttttcttttttcagcgcatcgttctgttcccggatccgctgtgtcattttggttatctcgctctgcagaatggaaagttccccttcttcagcttcactgataaacagatgatccgtattatgaagcacaagatcgatttgctctgaaatctgtgcaatccttttgtacctggcccgcgtaaatacaaaaaatgccgcgccaaaggcagcggcacaaacgagggccagtcccccggccgccggattcatgtaaaatcccgctgccgcagcggcagcggttatgatagcgcatgcaatggcaaactgccggatctccctattccgaaacatatccatcccccaatcggtagcccgttccacgaaccgtcaaaatgatctgcgggtctgccggatcatcctcgatcttctcccgcagccgcttaatatacacggacaacgtattgtcattgacaaactcacccgccgcatcccataattcatccagcagcctgtccctcgtaagaatatgattaggattactgataaaaaccagcagaaggtggtattcaagtgcagaaagaaaaaccctgacgccattttttttcacaataccgcttgccgtatcgacagaaagcccgcagatttccaaagccgacggcgactgccccgatctgcgaagtgcagtcttgatccgcgcaatcaattcccgtgggcggaatggcttagtgatataatcatctgcgcccatgttcaaccccgtaacaacgctcgcctcatcacccgaggccgtcaaaaaaatcaccggaatatcccgcgtctgtttgatctccgtgcacaccgtaaacccattaccatcgggcagtgaaatatccaccagcgccagatcaaatctatgctccgcgaacatggcaatggcttcattctgcgtagaagcatgcgtaaccgcaaacccctcagagtgcagcaaaagcataagatttttggcgattgctctatcatcttccactaaaaatatctgtttcatacatttttatcatcctttatttattttttaacctctaataactataataatctccatacatctttcattatattgcccgcccccctgaaatgcaacttacagaattgtcatctcccccctcactattttaacattccggaaaatcaatacgctgcttcggttacagcccctcccccggcagacgaacttatctgctgaccagatgtgcccagtgaaatgaaggggcggccgatcgatcccccaacctcacgcctctggctgcatccacccattgtagtttaaaagggtgtcggctatttgcgtgcggtattctctcggggacatttttacggtctgctggaagttgcggttgaagctggatacggaaccaaagcccgtgttttctgagatgctcaggatggagtcttcggtagtacacagcatgttgcatgcttctgcaatccgtacctggttgatgtattccaggggggacattcccatgatctgggagaatactcttctgaaatgggtggggctccagtgacatagttcggcaagagtatctgtcgtaaaggattccatgtaattttgttctatataatcgagtgcgggtgagagtaccatggtattggacttgctttcatcttctgtaagggaaagattccgggaagctttcaggttctggatccgatacagttcgatgtacagggacagcagcaggccgcgtgtgctcagctggtagcctggctttttcccggtcatctctgaaatcacctgcattgcgaggctgtagattcgttcggagtcttctttttttaataggtactgatatccgtttgttcctgctggcgccaggtttatattttcccaggaaccgggcatccagccgccgaacatcctgccgggatcaaaaaacagataggaccatttgctttttctgcccttgtcagaataggtagtgtgaggtatatttttaggaatgcatgtcacgtttcctgcctcaaatcccaatgccccgccatagaattctatttttccgctctccgaatggcagatccctacttccagacagttgtgaaaatgcaggcgcccgctgggaatatccgatatcttccagtgctccccagtcaaaagcagcacgggaaaatactccggaagatgatagctgcggaattccgttattttatattctccttttgaaacatttttacgcatatacttctctccctgttttaaatttgtgtatagaatccggtgaataagactgtctaagcctgtctttcggatgtttgatttatattttatcataaatggtcatttttgcgcactttttttatccgggtgattagacggtatcggtcatttgaaggataataatgctacaaacatgtataacacgtaatccaaagatagagaggagaccagatatgagcacaacaaaagggggctttacccttcccggggaagccggatatgaaaaactgacgcttgaaatggcagagaaatggggggccgatgttatccgtgacagcgatggaacggtgctttccgatgagattctggaagcaggatacggtatctactccaccatctgcatcatccgagaccataatgactgggcaaaaaagaacatggacaaactgcagcagacttttctcatcacacaaccggtaaccgctgcaagtgatacgctggagattgatttgatgaaagatttctttgaggagcagtttgctgtcaatgacactcccgatgcctttaaatactggcaggtatatgacagaaccaccggccaggaggttgacaggaagcactgggattactcagccggaaaccgtcaggtacggctaaaagggattactccctggcataattacacggtctcctttatggcataccgtatctgggaagagatctctatgtacaaccatacgaccaaccattgggaaaaggagcatttgatgcagattgatccccgttacgaggaggcacaggagtatctgcttgcgtggatgaaaaactggtgtgaaacgcaccaatctacgacagttgtcagatttacttccatgttttacaactttgtctggatctggggcagtgatgtaagaaaccggaatttattcaccgactgggcatcttacgattttaccgtcagccccagagcgctggatctatttgccgagacatatggatacagtctgaccgcggaagattttgtaaatcaggggaaatatcacgtcacgcatatgcccgccggaaagacgaagagagactggatggattttatcaatgattttgtaatcgaatttggtaaaaaactggtatccatggttcatgactatggcaaaaaagcctatgtcttttacgacgacagctgggtgggaatcgagccttacaacggacgttttgaggaatttgggttcgatggaatgataaaatgtgttttcagcggctatgaggcgcgtctctgcagcggtgttcctgtggaaacccatgaacttcgcctgcacccatatctgtttcctacagggataaatggttcgcctacatttctggaagggggcaatccgaaaggggaagcccagaaatactggcaggccgtcagacgcgctgttttaagatcccccattgaacggatcggacttggaggttatctgcatctggttgaaaacagcccggaattcgtggagtatattgccgacaccgcagacgagttccgcatgctcaaagatcttcacagccacggaaaacccgctgtgttaaacccaaaggtggctgtacttcattattggggcgccctgcgctcctggacattgtccggacatttccacgagacatatatgcatgatttgatccatatcaacgaaagccttgctggacttccttttgatgtctcattcatcagttttgaagatgtcaaaaacggtgcattaaaaggaatcgatgtcgtaatcaatgcaggatatgcaggaagtgcatggagcggaggagactgctggaaagatgagcataccataagtattctgaccgaatgggtttataacggcggaaccttcatcggagtcaatgagccttccgcattggaggggtgcgacacctttttccgcatggcacatatactgggcgttgatgaagatacgggggccagagtgtgccatggcaaatggtcatttacagaagaggccccggaaggtctcttcccggctggaagttatatacatgcaagaaagggaatttatctgactgacggtaaggcatccgtcctcagagaagaagctggcatgccagccgtgacttcctgcggattcggctccggcagggggatatatctggcatcctttgagtactgtccggaaaatacacggctgctaatgaatctgatcctgtacggaacaggcgggcagcttatgccggaactggtaacagataacctgcatacggagtgcgcttattatccggagagcagtatgcttgtcgtgatcaacaactccggccaggaacagaacgcagctgtagttgtaaacgggaagaaaatcacatgccggatggagggctatggaatttattgtgagcgggtttaaaatgcgggggatgtagtacgcctgacagcagcggggagcgggaccggccctcagccgggggacggtcccgctccccgctgctgtcaggctgggcttcttccagacggatgagaaaccgcttacggaggggaaatttggtgggaaagggggatgggattgggctgtggggaagcttctctatctcctaatgtttttttatgactcaaatatggcggcggctttttttagttcttctcggatttggatgtgctgcggacagacttcttcgcattttccgcattggatgcatgcggatgctttattccagccgtggccttctgtgctccattgataggtacctccggcgctttctttgttgccataggttttcaatagatttactgcctggaatattccgtatatggcgatattctccgggcagcctttcatgcagtatgcgcaggcagtacaggggacggttggcagcttgctaagacctttttgtactttctgcactgcttctctttcttcctctgacagcggcctgaacgctttcatgtatgagaggttatcctgcatctggctgatgttggacattccgctcaagactgttatgatgccttccagagacgcggcatagcggattgcccatgaggatactgacgcgtcgggatcggccgccttgaatatgttctccagattttcaggaagcgctgacagattaccgccttttacaggctccatgatgatgatttctttgccgtgttttctggctgtttcatagcacagccttgattcgatggtcggattgtcccagtccgcataattaatctgcagctgtacaaaatccatttccggatgagccgtcaggatctcgtccagcaacgccgctttatcgtggaaagaaaatccgagattgcggatcagcccctgcgctttcttttctgcaaggaaatcccagattccaaagtcatcaaaggcctgtgatctatgttctcccagattgtggagcaggtaaaagtcaaaatatcctgccccggttctcttcagagaggtgtcaaacattgcttttgcctcgtctgcgtcctttgcatcccaggccggaagctttgtcgccaaaaggaacttatctcttggatagcggtcaacgagagcctccttgattgctgcttcactcttgccgtccacgtatccataggctgtatcaaaatatgtaaatcccgcctctaaaaacatatccaccatctgcttcgtctgttcaatatccacgtcctcaccaatcatcggaaggcgcatcagcccaaaacccagttttggtatattgccgtatcggttttccattccatgttcctccattttgctattattttttatacttaggctatggaagaattatataataattccatgaaaaaaaacagaccctcaggctcacttttgaaaaagaactgcttcttcgaaaaactccagccgtatctcctcaatccacggctcataaccaaatagcccctgcccggcgtgttccgccatcccgataaacaattcccccgcagtcttgtttgtcttatatgtatgcagctcatagtccatctcggcgccatatattataatgtatccgtccatgtccgccgtaacctcagtaatacagggcatgtagatttctccggtactcccattttttgctgccagataaacaacaataagttctgtatattgtatttccgttttatgatcatcctcaaagaggagaagcagcgattgatcctgaaaaataatgctcagaggggctgcaatcagtgttcttttattcataccggatcctccatctcatctttccccattacctcagaatctatattctgtggtaattcatccgcaattaggaacagattctctccgatatgtcaaatgaaatgtgcttcttttgaattaaacaagcattttagacacactgaaacagacctgtagtaagtgaataatcacaggtcttgttgtggttcaaactacttttatccaaggcagtttatgataaattttttcgatatactgtgcgtctatagattataattgaatattcaagatttttcatatataataaaaccaaccaaatttatgtaaacttttttcttttttaccacagaatatagattctgtggtttttatataatcagctgcatgctgtcaaatatcctgtcaaaatttctataactggacgcaatataaatccttgttgtctcaatagaggaatgccccagaatatcagcgagatgggaaagattcttttccaccgcataaaaacttctggcaaacagatgccttaaattgtggggatatacttttttcggctttacgccagcataggccgacaggcgtttcatctcatgaaaaatattagagcggtcgacaggttttccatttcttgttataaacacacttcctgtacggatattctgctgatccatatagtctttcagcttgtttttcaattcattcgggagcagaatcacccggtgtttccctttcatatcaatctccgccctcccctgctggacagcatctgcggtaatatacttcagctcactgattctgattccggttgagcataaagtaagcagaatatggtacagacggattttgcccctttcacgtgcggacaacagcaatgttctatactcttcctctcttaattctttttcctcctccacaaacgactttttctgtacttttataaatctcacacggcattccggcctccctatgaaatccagaaaagcattcaccgctgacagcttcacattaatggtctgtgccttgtactccggctgcattgcggcccggtattgcatcaccctgcttttggtaatatcaccgccgtccagataatcaagaaaatttcggatttcattgatatattttttaatcgtagccaaagatttttcattcatcattaaattattttcgaattcccctacttttttaatagatattttttctgtcatatgttttcctcctttttatatattaaaatacatttttgacagaaaaatatacatataaaaagcacctggaataaaacttcatccaggtgccctctttggctgatctgtttttactcggccagcgcttttacctcttgatattttactaagtctgaatacatttcccctttgtaaggatttttctttgtcttcttaatccggtacagcatatatacgaatactgccgcattggcaagcagagccagcaggctcataacaaataaaaatgtggtattaggcgcagcgctggctacctgataaatccccgcatcctttaataccgtgaacccgtctgcggccagaaccccctcctggatcgccgcatctgcaatcgccttgctggatgcggaatgaaccagccatttactcgcatcctggaacgccggaaatgtctgggcaaacatgcaccacagtgccagcgtatgtgcgcggtgctgcagccaggccccttttcccagtgtaaaagcacatacagtgggggccagcagcagcgcaaatccacagtaccatgcatgggtcggcaggcaattgtatgtataggcaaaattccataaatcataggccacaatccagaaccacatcatatccggccagagcatgtcgcggctgttatcatttgccgttttcctgcggatacaaatcccaaaccagccggaaattgtgataatattcagtatacccgctattccgttcatgatattccaggaaccgccgacataatactgtacctgattattcatgtattcaaccaccggagttgcatactggctgacctgaaaatctctggaacacgcctccagaatattgatcgccagaatcaacggcggaaaacaaagcgcgatcttgttgtgctgcagcttctttatatggcgtatgcaccagaatcctatacatcctgccgtggatgaatatacctttgccagatggaaccagtccatataggaggtatctttgagcgccgtcagccagagtacggtcagcaccaccggcaggatcacaaagcatccgaaccccacccatttaaagcggcggcttaattcatttgccgcaaacagcgatataaatacaccaatccatacgagccagaccaatattgtcggcacactttctgtaaatacaaacatcatgaactctccttccctctcatcgccttaacaggcggtaatttcctttatattaaattcatttccggcagtcagccaggtatcttctccgccgcagtgcggacactgttttttatatttcagtgtagaaaaagtcttctggcaatccccgcagatcgttaccgccggtattgtttctatttttagctccgcttccttcagaagttctgaccttgcccgaaaatatttccagcagtcctccagataatccggaataacaccgctcacttccccgatctccagtgtcaccgaagctacttccgtcagtttttcttctttgccaatctcctcgatcgcgcggactacatgcgtgacaagccccagttcgtgcatatctcatccccttctttccattatgcagctatttcctgttgcggataatcttaatctgtcttttcgccgcgtagggcagaattgccttcatcttatcttcactcttcatcatccggcttgcctcgggaatttctctgctcaaatggatcgcatcaaattcacattttgtcgtacagacaccacagccaatacaccggttctcatctactattgtggcgccgcatcccaggcaccgcgcagtctctgcttttacctgttcttctgtaaacacaaggcgcgtatcccggaaggtagatgctgctttaactccggccttatgccccggcgcctggcggctggcatggtcatagctttcctccggaatatccaggtttttcttatccagttctataaattcacgccgattccggccgattgtcagactctgtccgtcatgtacaaaacggtggatggagaccgcgccttcttttccggccgctatcgcatcgattgcaaactttggcccggtatacacatctccgccaacaaagatatcaggctccgctgtctgataggtcaaaggatctgccacagcgccgtttccacgtcccagttccactttagttccgtccagaaggcctccccagataatgctctgcccgatactcagcagcacattgtcacattctactgtcatgcagtcgtcctcatcatattgtggatgaaaacgtccttctgcatctgtcacagccacgcattttttgaagaccactccggtaacttttccgttctcaccaagtatttcttttggtccccagccgcaatttaccgtgattccttcttcctgtgcctctgccacttcatcttcagcggcaggcatggaatcccttgcttccagacaatacatctgcgttatagatgctcctgcgcgcactgcactccgcgccacatcaacggctacattgccgccgccgaccacaacggtccgcccggacaactgtaccttttcatccgtattaaccctgtgaaggaaatccacacccgtcaaaacgcctctaaactcttcgcccgggatgccggccctgcgtcctccctgacatccaatggcaaggtaaaacgcctggtagtcctgtgcccgcagctcttccagtgtaatatcttttcctacttctataccgcatttaaactcgattcccatctcatgcagcaccgagatctccgcatctaccacctctttttccagcctgaagcctgggattccatgagtcagcatccctcccggctgtctgtgcttttcaaagatggtcaccggataccccttctgagccaggaaaaaagcgcagctcatcccggccggtccggcgcccacaaccgcgatcttctgcgggtatggcttcccgatctgattgaccatcggcggaatataacgggactctgcattcagttcctgcatggcaataaacttcttgacctcatcgattgccaccgcctggtcgatctccccgcgggtgcaagcatcttcacagcggcggttgcagatacttccgcatactgctgggaatggattttctttcttaatcagcttaagtgcatccagataccttccctgggaagccatattaatataaccctgcacggcaatatgcgccggacagttcgtcttgcacggcgctgtccccgtatcatagcagttcatctgattatcatctctgtaattttcattccatttctccggcccccacttcaccgcatccggcagttcctgcatcggataggataccggcccgctctttgtacagagtttctgccccagcctggctgcaccggacgggcaatattccacacactggccgcatgccacacagttttcggtattcaccctggcaatataagcggagcgggacatattcggcgtgttaaacagctgagaggtacgcagcgcatagcaggaacagacacagcagttacagattgcaaagatcttatcttccccatcgatattagtaatctggtgcaccaggccattgtcctccgccctctgcagaatctccatgacctctgcttcgtcaatatagcggcccttccctgtctctacaatgtaatcggccatatctccgaccccaatgcacatatcatcctccaggtgtccgcagccttctccctgaattctgcgggaacggcggcaggaacaggcgcccaccgcatatttccctttatacttctgtacccagtgggaaatatgttcgacactgacggacttctgttccgttggtatggccttttcaaccggaatgacgtgcatcccaattccggcgcctcccgggggcaccataggggttaccttttccagcggcagccggctcatctgctcaaaaaatctggcgacctcatgatgtttctccacctgctccagattcatgttcatgaattccgcacagccaggcacgaacatcggcagtatgtattgtttatggcggtccgcattttcccagttatactccagcagaccgatcacgctcatctcctgcagcaattcttccgtccgctttagcggtttaccgcatttcttcgcaatctcctgtgcactggccggctttcttaccttcatcgccagagccacttccgccatctcatccgttacaacacaggcgagcccccagtattctggatcatccacggtcactttgtggccgatcctgtccgttatcttctgacctaattttaagatcaatgctctctcttccgccattgctaactcctttccgccttctgccatgcctttacttcttccctgagccaatcggcccacgcctctgttccctccccggtgcgggcacaaattggtataatgattgcattcgggtttctctttaaaatgttctttctgcattgttccatatcaaaatcaaaatagggaagcacatctatcttgttgatcagaacgacgtcgcagatagaaaacatcagcggatatttcaacggtttgtcgtctccctcaggtacgcttagaatcatggcattcttcaccgctccggtatcaaattctgccggacagacaagattccccacattctcaagtacaacaaggtccaattcgccgcactcaaggccctccagcccctgtcgggtcatatctgcatccagatggcacatcccccctgtatggagctggattgctttaaccccaagctcagaaatcgtttctgcatctacatcagaatcaatatccgcctccatcactccgatctttaattcgtttttcagctgttcaatcgtcctgctaagtgtagtcgtcttaccggaccccggtgaagacatcaggtttagcaaaaacacctttttttccttcagttctttcctcaattgggttgcccgtttctcattatccgcaaaaacactctgcttaatttccagaaccctgaaatctcccattctcttctctccttcgttcataattggttgtaccacaatttgttatctttttaacattgtatcatcccatataatacatgtcaattataccctttatttttgtgcaataagcaacatattcccattcattttagtgcacattcacctaggttcacgcctttggaatctggtatgaccacagccacttttttttatcctttgtactcgcagttactctgtactttttgtattttcagtttttttaaaatctattgacagaaattgcttattagtatatattaaagatgcaaggtagtttgttactcaagtaactaactaataaggtggtgatattattgaacataaatccaaatatagataaacccatatttgttcaaattgcagaacagttagaagattccatatttacaggcgtgttcccagaggaaacaaagattccttcaaccaatgaaatctcggcacttttgaacattaatccacatacggttctcaaaggaatgaacatgctggtagacgaagagattatttataaaaggagaggtcttggaatgtatgtaaaagcaggcgcagttaaaaacatccgcagaaaaaggcaggatcaattttacacgcagtatattgaggcattaattaacgaggctgtcaaactgcagatgtcaaaagaagaaattatcacattggtagaaaaggggtatgagaatgaatgcaattcaaattaaggatgtcgtaaaacgatacaacaatgtcaacgcactggatcgggtttctttgtcctttgaatatggtaaaatttacggatttttaggaagaaacggagccggcaaatccacattaattaacattatttccaaccgcatcttcgctgatgagggggaaattctgattgacggtctccgtgcaaaagaaaacatggaagttcacgaaaagattttttgtatgagtgagatggacttatacgacaccagcctgaaagtaatagaacattttaagtggatagaccgtttttatgatagttttgacctggatcaggcacgtcagattgccgaaaagtttggtcttgatattaataaaagatacaaagcactgtcgaaaggttatcagtccatctttaaacttacgattgccctttccctccatgtaccttatgtggtttttgatgagcctgtgctgggtctggacgcgaatcaccgggagttgttttatgaattattactgcaggattatgaaaactatcagagaacgattattatagctacccatcttatagaagaggtggcaaacatcatcgaagaagtggtactaatcgacaagggcagagtgcttctgcaggaaaccgttgaaactctgatgaataaagggtactgtatttccggcctcgccggtgaagtcgatgactactgtaaagacaaaaacgtgataggatacgatgaacttggtaatttgaaactcgcttatatactgggcgaaaaagaacagcttcctaaaaacagtcacttacagatatctaatatgaacctgcaaaaactattcgtaaagttaacagagaaagggggccgatgatatgaaaaaattaggcactgttatccgttatgaatgtatgacatcgtttaaatatatttggatcttctacgcaattgaatatgcagttgtcgcggccgtttttgtcctttcttatattacaaacggaagcagcggcaaaattggtacgaacggcttagagtttaattcttttatctatgtgggtatcttagggatcctggggtttaaagaagattttaaaatgctgatacagaatggatttaccagaaaatatatatttctatccacgttttccctgttcgcttttatctcgggaatcatgtcgctggttgatacaatcctgggaaatgcgcttcatcactggtttcatgattatcactcattatttggcggactgtacggatacgggcattcatactttttgggctgggtttggctgtttttcgtatatatgcttatctgctgtctgttttacctggtaatccttattataaacaagatcggtaaaaaaatatcagtatatgctgggattaccctcggcctcacaattattttaatcatacctgctttgataaaatttgtacttccaaaagatttaactgacaggattgccgcatttggcttaaaggcttttggattcatgaccgacggtacaataaactttatgtatcctgtatttatctttgtactggcagcgtgtattttaaacctctgttcatactgtgtcatacgcagaacagagcttaaagcataagcatcctctcatgcaacatgcagtaattggggaataatatagcccatgactgcttagacagccgctatggacgaatccataacggctgttttatatgccactctcccagaccttattctagtatcttccatagtcctttgcaatttctaccattctgtgcgcccttgcaaaatcggcatttgcagggtattcacatcccgttgcaagtatgaagccccctccggctgacattacgtcaatcgaatctctgcattcctggtcccagttttcgtcagtgccgattgctgcacttgccggagtaacacacccgatcagggttgttagatttccgtatttctctttacattctttaaaatctttacaatcatccggcggatataagaaggaaatcgccgcgggctgcatacgctcgatctgaacatcaaagtagattttctgcccgcaattgtgtatcatcaccagcccatttttatctcttaccacctgggcaagctcttccaccagatctccctccagctcattccacatttccttgctcatgatagagcctgaggcaaaaagggtgtctaacatgatgccgttcactcccgtatccatcagcgccctgcagtaatcctttaaggtctcattaatctcgcccgcggcttcatgcaccgcagccggatcatcataaaaatccatatacatttcctgctggctccgcagcatggagagcgtacccaggggaccaaatacaaatgctataatggggaattctcctttagaggcttctaccaattttctgcatgtatcaatgtgcatcatcatacgtctggagctgtggtaatccactttcttaatcctggcataatcctcaatctctttcactacgcaatgctcaaaatccggatgcgcagcttcattttccggataaatcaattcctgcccccatgcatcgcattcaacggaaagatcaatcaacgttacgatacaatccagatcaaactcctctctcgctttcaagagagcatccgcgcacagctgtgcatcgttagcccattctcggtaacttactcctgtcagtctccgggaagccccgctgatgatagggtataccggcaccctgtctgcctcctcgtgattcaaagcttttactacccgttccattgcattcattataattccctcctgaaagaatactgttcaatatactgctgtgtcattggcgccctgttaattcataccaaaattataatatacttccggatttgtttttgtatttttttaatattttttatacttttttagtaggaattaaaaaatcttatcttaatgttaatgcaaaatagtaagcccatagaatccggctgtataaattccaatgtttttttagtactccttttataagacaaaaatggatgccgcgttttctcccgcagcatccattttttgtcttattcagaatgtttctttcaatttccagataaacgggtgtccgcccttggttttaagcttaactttctctcacagcttctctaattcttttttccctctcccgcagattgggcatttgaagtcttccggtatggtatctgattccaggatatacccgcagattttacagcggtatccctttgctttttcaggctcagggatataactggatgcctttggaggtgtaacaccatttttcacagtatgataatatgcgtatgtcataggctcttccgcactcagcacttctgcatctactacttctcccaggaatacaatatgtgttcccacgtccatcgtattttttactttgcagctgaaccttgccgctgcctggctgcacacataaggaatgccattgagatccgtcttcgtctcaaattcctcaaatttatccttatctttgccgctctggaatccgaatgctccaatcagctccattgtggctgattgtgcaagcgcgatccctgtaaaataccccgactcctgtattaaaccggcagtataattttctttgttaattgtcaccgtaacctgcagcggttctgaagtcacctggatcattgtatttacaacacaacctccggctttttccccattttttgccgagataatataaaggccataactcatcttccaaaatgcttttgtatccataaacgccctcctttaataatagtaattattattgatatttaaaatataacatatctgctaatattttacaatccttaaatgtaattaataatctgcaaaaaacggagtaacataatgatcggaaatccaaacggataaattaagaaataaaaaaggagaggccggaatcgcttccggccaaggaaaattatgaaaaagaaaatttataataaaaaggttattgtccctttacaattaataatataccgcctaaatgtgatagttatgtgagggataatttaacaaattatgtacttttttcgaaaaaattattaacaagttcaaagagggcagctcaaaggggtctgacccctttgcatcggggtctgacccttttgtttcttttgcttattcccccaaaatatccttcaagtcgttctccggcgtagtaattggagcaatattgtagtgttccaccaggtaattcagcacattaggagatacaaaggccggcagcgttggtcccagcttaatgttctgaatccccagatgcagcagagtcagcaggatacaaaccgccttctgttcataccaggaaagcaccatcgagagcggcagctcattcacctggcatccaaaagcctctgacaaggccaccgcaaccttaatcgcactataagcatcgttacactgccccatatccatcattcttggcaggccccctattgttcctaggtccaggtcgttaaaccggtatttgccgcaggcgagtgtcaggatcaccgtgtccgccggagtctgctttacaaattcagtataataattgcgtccaggacgtgcgccgtcacagccgcccacaaggaagaagtggcggatggctccggcttttacggcgtcaattacctgtcctgccacactgagcaccgtaccgtggccaaatccagtggtcacactcttaccgccgtttattcctgtaaactccgtatctgcctcatatccgccaagcgccagcgctttttcgatcacaggtgtaaaatctttatcgctgccaatatgaaccatttcaggataagacacgacttctgttgtaaacactctgtctgcataactttcttttaccggcatcagacagtttgtagtgtacaagatcggagccgggatatctgcaaattctttctgctggttctgccatgctgtgccgaagtttcctttcaaatgaggatactttttcagttccggatatgcatgagccggaagcatttccccgtgggtataaatgtgaatgcccttacctgcagtctgttccagcagaagcttcagatcccagaggtcatgaccggtaatcacgatgaacggtcctttctccactttcattgtcacctcaaccggctgcggtgtcccaaaggtctccgtattggcacggtcaagcagctccatacaggtcagatttactttgcctgtctccatcacaacagggagcagttcctccatgccccagtcctcacccaggatagaaagcgctttgatcataaattcgttcacttccgcgttctcatatcccagaaccatcgcatgataagcataggccgccattccccggatcccgaacagaatcagtgatttgagggaacggatatcctcctctgcgttccagatgcgggacatattaaagcggtccgtattaccgcacggggaaccgcaggatgcgcatccgggcacaatccgccttttctcttcttctatacggtcaatcatctcctgcagagtctcgtcgttaaaattcacattcgttaccgtcgtaaaaagcccttccagaatcagacggtccgtctgctgtgtcttggggttatttgaacaggcacgcgccagagcgatcagtgcacccgtcagttcgtcctgcagcttcgcagatgaagctgatttgccgcatacacctgccttacctgtacatcctgtgcatcctgccgtctgctcacattgaaaacaaaacatttgattatccattttatatcctcctttatatggctttctatatggtcttttcgggaaatacaacagtcaaaagcatcttaaatgcttccgcagcataaacagcatgcggcttatttgccggcataatcagtgtctcaccacccttacagaagtgttcgcgcccgtctaccgtaaagcgcccttctccttccagcacctgcaccatagcatctcctttagattcatgggtgctgatttcctcgcctttatcaaatgcaaacaatgtaacgctgacataatcattctgggccagcgttttactgactatctgcccaggctgggcatccaccagttccgtcagtgacaatacagtttcatggtcaatgtttttgatatgttgcattttctctcctttccgctgcatcacagcagcaatacccgattcttgatctgtccggcagcgcatgttccaaggaacatactctgtctctttctgcaatggaatgaatctgaatctttacagcatccttccggctgttctgaccggacgaacttaattctaatcaatcactcctccgctgctaagtacagtataatgcaggtatgcattcaagtatgttgttaaaacaacaaaaaaaagaaaaggctgaatttaataaaaatggtaacagttcaggcctgtctgaactgttaccataaatggacaatctgtccttcgcgcgcctcgattaaatatgcagatcaactgtatttactgctgaccgcgcaatctgcttcagttaggttttacttcgctaaacaaatttcccgccctccgcgctgctcgtacagtctgtgggatatggaaattaccgttctgtttgtcgacgctgcccggagagcctccagtactttctcttctgtggccgaatccagatttgcagtaatttcatccaacagcagaattcttggattggcggctacggctctggcgatcgaaagcagctgcatctgtccctgcgaaaacaggccggcggtacacagggtatcatatccgttttccagatccataaccgcctcatgcattcccaccatattaaccgcccgctctattttctcgctggttatcctgctgtctttcaggcttatctgctctgccacggtccccgggatcagccggaatgactgctccacatagccaaaaatccccctcttttgggcatccgaaatctggtctgacggtaccccgtagatgcgtacgtttccgttccacggaaggtacaatcccagcagcagcttgaataccgtgctctttcccaccccggttcttccggtcaatgtcacattttctcctgtatgaatctcaaaactatactggcggagaatttcccgcccgtccccatacccaaagctgaccgaatgaaacgcggctgccgggctgccttcatccagagacgccgtcttattttccggcatcctgcgccccggctcatttagaaattcatgaatgcggcatacccctgccacggcagactgaatgttctgaatctccatcccaatactctccaacggctcaaataccttgctgacatatgcaatcactgccactgctgttccaacagacattccaaaaagctcctgcatatttccgcccattgcagccagaaccatcataaccgcaatcagagctgccctgattgtaatgataatcggagaataaatggaatcataaaaattggatttttctaatgcctggtatccggccaggatatatcttccataacatatttccatatatttttctttgtgaaatgtatggatcatccttatattcctgatcgtttccggcacatggctgtttgccctgcccaccgcggccctgttggctagctgggacttcagcattcttttttgaaatgcatgtgtaattaaatataaaatcggtgacgcaagcaccataagcatcccaagcccccggctctttatgaatatgactgccagaatactgaccaccctgcaaatatccacaaccatgctgataatgccggatgtaaacaaggattccaccgtatctacatcgtttacaaatcttgatgccgtcactcccggttctgtgtctataaggtaggatgccggcagtattgacagctttctgcacatcacacttctaagtccgtgggtaaccttctggccgaaaaccgtgatcaggctttcctttgccgaatcaaagatgcctgccgccgccagcagaagaaagtaagccgccgccagccccggcagaacatctgcgcctcctgccagccggtttacaatccgttccagaagcagcgggggaaggatgcccgcaatgacagtacctgccactgcaaacaccagtccaatggacaaaaacacgtgttccttcacaatcctttttaccgccgaaaggatataattctgcttcccgccattctttttcccggtctgcccctcctgaaccggagtcccgtccttttgcgcatcatttaagttgtctgtgcattctgcctgtctctcttctccttctatgaacggcacgctctgtccactctgcatttgaaacagatgcgcgtactcctcattggtccgcatcagaagcctgtggtcagaaaccgtacttctgccctccccgagccagattacctggtccatctgcggaaacagagtcagcctgtgggataaaatcaatacgatactatccttagtgagcgcctttaaattctgcataatctcacattccgtttttctgtcaaccgcggaaaacggatcatccagtataatgaccggctttttatgaaaaagtgtccgcgcaagtgcaatccgtgcctgctgccctccggaaagcctgactccgccgctacccaccatggtgtgaatcccatccggcatcttcgatacttcctggtccatacacaccgccttcaggcagccactgacatccccggattctccaagcagtatattgtcctccacggaagcgctcaaaagttccggctcatgccccatataagcggtcatctttcttccagccctggcaagagccgacagttcctttccatccagcctgatacttccctcatatggatattcacatagaaacacttttcccagcgtggactttccacatgccacggatcctgttacccctattatctcgcccgggcatgcggaaaaactaatatcctccagcacatatttcccatccgggtatgcaaatttcatccccgaaacacaaagccgtaccggcgattccggctctggttctatctcatccgggatatcctgcatatacggtttaatccgtatccatgatacctgtgccttctgaaccgcattaaacagctttgccgccctcgaggatttagatgccagtctggtgaaacaggataaaaatgtagaaaatgccgcaatatcccaggatgtccatccgctgcccagcacattttttgcgccgaaccagataatgaaaataatccctgccatagaaatgattttatagaggggctgcatcgcattttcccatatattggcatacactgctttcttctcgtaatctcccagccgatcctcatactctgtatccctgcttttttcctgcccataaaccctgtaaagcactgcattggatatccggtcaagcgttgcaccgttcagaacgcccgcactttccttatatgccgctgcactccttgataccgtctgttttaatgttccggccagccagtatgccgccggtggaaacaaaatggatattatagtcagcctccagtcgtatgaaaaaagcatcgtcagataggcaatcatgacaacaccggtatcaaaaacctctgtcgtaaactttcgcatcccttccacgcaagtgtccacatctgcaatggccttggtcataacagctcccacatcctcagtgtccagttccggcttgcccctgtgcacaagattatggtacagcacctgcttcatattccgattcacatggttagcaaatcgtctcacataaagccgtttgagatagcgcattccctccaccagtaaaatagaagcaatataggacaaggccagcataaccatatcctgaaacacccgtttcccgccgagaatatcgcacagatactgcgccagcattccctcaaaccaggggcctgcaaccatccctgcattgtaaataatcccggatacggcaacggcagcaagagtccgcttctccattttaaaataggatacaatacgctccggcttgttgaccttaagcgccttatcttccatctctgtcccacctctttttctcaatcacgttcccttcctgtctaacattcaatgtggcttagatgatactacaactgccacgaaaaggcaatatcaaccgggtcctttatctgcattatatcccgttatatgactaatttaaacacttctggcaaaacagggcaagttaagcagtttccaagggggtgcccacactacagtcgtcagtgccaggctggcctgactacagctcgttgcccgcaaaaataaaagatccgtatgcttattttctgaagcccggcacttagccggtaagcatacggatctccatattttcttttccttttactaataccggttattcttaatcattttttcttagttgaatcctgcaaatcagccatatagcggcccagttttgtttccccggaaagtaattatcctgactgttatattcgcagtctcactattctgcattatgaccgtttttacttgaacactctgatttcagctggcagcacggcggacacagaggacatgacggcttcggcgggcatggcggctccggcgggcatggcggcttcggcgggcatggcggcttcggcggacatggcggctctggcgggcatggcggcttcggcgggcatggcggctctggcgggcatggcggcttcggcgggcatggcggctctggcgggcatggcggcttcggcggacatggcggcttcggcggacatggcggctctggcgggcatggcggcttcggcgggcatggcggctctggcgggcatggcggcttcggcggacatggcggctctggcgggcatggcggctccggtggatatggcggcctggatggccagtatgggtaccaccccggcggcggacacataattatatagtttggccatggatacatgcctccctgccataatccgctattgctgttactattattattgttgttattgttattattattgttgttattaatactaatgcccgtctgagagtgggacttcttctccttactacgtggtacagaggcacatacgcagacagatgcctctaagtttacctggacatcttcgaacgtcgtacctataggctggtaattttgccccgtacccgttggattcatcgtaacaactcttgtgacagttcccgtaaatgaggcgtgaacggtaaaacatatatagtctctaatagttcggactgcaatataaaattcctctccaattgaaggtgcatccattttattcccgcaaaaatccataaaagatgcagagaatccttcctgacaaacacagatcggctctactgttatcaccggttttccggtaaatcccgactgcagtataaatgggccgataagaaggcgcccgcatacagttctgacttcatccgggcagcctttaaaaacgagatatggttcgttagaaacagtcgggattgtccctgtattgcagcagtctataggattatccgtgcagcatccagctgtatttgcgctgacaggcggagccggatttgccacagcgtctgcaaacttcccggccagttccaggagccggagcactgcggcacgaagcctggctgacttcggatgctgttccgtggatgaacattccagaaaattcacttcatccggagcaatctgccccaagagcacccatagcgccacctgaaccgccgcataggcatcattatcatcgaggaccggacttgcagcataatctgttcccgttaactcaaaagtcgcctgtgcgctcacagcaggatagttatttgccagaatccaagccagcatctgcttttggcgctcggtagctgaagtgaaaatagtttcaaatggtgcgctcctataaggtacatcattatatggaccatccgcaaatttatcaaggcagtacgccttttccgtaactccattaatagtccttcgaaattgaaaaatattattatgatcgggtctgtccaactgatatctggatgcggaagtgtacggcagtgcacaataattgcgcacctcagcgtccccagtcgcagtccctgttaagtccgtacctgaataaattataaatggacgtgatacaagacgattcgtttcagcattattacttaaagccatgtttcattctccagtaaaatcattctcacaatacagtatgctaaaccagacaaaatgtttcgcaaaataagacactgtccatattgttaactatttcatattctaagttgacattctatataatttcttttatactaacaacataaaatacaaaacgagaggaaaacatcatggaaaatgcacccatccaaaaaacatttatcacaactaaacagcttaccctcatcggggtaatgacagccgtaacatgcatactgggccccttcaccatccctcttcccttcagtccggttccgatctccttcaccaacctggccgtctatctcaccgtctacgtcctcggcatgaaatttggaaccatcagcttcatcacctacctcctcctgggagcagtgggcctccccgtattctccgctttcaccggaggaatcggaaagctcgccggccccaccggaggctacctgataggcttcatcttccttgccctcatagccggcttcttcatagatcacttcgcagcccgtctctccttcgccctcctcggaatggtactaggaaccctggtctgctacgtcttcggaaccacctggcttgcccaccaaatgaacctcgactttcccgccgcactagccgccggagtcatcccctacctccccggggacctggtcaaaatcataatagcaaccctcctgggccccaaactaagagccgccacactgcgccaataaatccaataactgccgtaaaactcccacttatattaagaaatcaactctacatgtatcacccccgcctttaatcggaagcctgtcccaggcgcccgattaaagtctccccgccaataccgtcccccatctcattctccgacagcctcccgacttgtttcaccagcgcagtaaacggataacggactggctgggggaatgtatatgctcttttgatatgcgggcgtctgcctgaatgattctaagaaaaaataccaccgggaatgtgggaggaaacatgattccgaatcatgtttccggatgacccagcacgagaaattatcaaatttctcgcgctgtgtcacccgtgcccacattcccggcggtattttttcttagaatcactcaggcagacgcccacatatcaaaagagcatatacattcccccagccagcccgtctatccatttacgaagcgtcccttaagccagcccccgcatggtaagctgtatcctttttttctttagatctacgctcatcaccttcacatcaacgatgtctcccacactgaccgcttccaacggatgtttgataaacctgtccgtgatctgggatatatgcaccaatccgtcctgatgtactccaatatccacaaacaccccaaaatcaatgacattccgaacagtcccttttaaaatcattccttcttttaagtctttcatatccagtacatccgtgcgcagaatcggctttggcatttcttcacgtggatcgcgggccggtttttccagctccttcacaatatcccgcagtgtaatctctccgatccccagctcatcagccagttgcttatagtctttgattgtaagagaaagccctgtcagattacctccggtaatatcctccggtttaaatccctgtctggatagcagcttttctgcggccgcataggattctggatgaaccccggtcgcatccaggggattccgcccctccataatacgcataaatcctgcgcactgctcataagccttgggccccagcttcgccaccttgagaagctccttccggtccttaaaccggccattttcttccctgtaaaccacaatatttttcgcagtggctgctgtaatgccagatatatatgaaagcagcggagcagatgctgtattcaaatccactcccaccttatttacacagtcttctacaactccattcagggattcgccaagcttcttctgattcatgtcatgctggtactgcccgacaccaatggacttaggatctatttttaccagttccgcaaggggatcctggagccgccttgctatagacgctgcacttctctggcccacatcgaattttgggaactcttcggaagccagtttgctcgcagaataaaccgaagcacctgcttcatttacaataacatactgcacgttctgcgggatttcctttaacagctctacaataaactgttccgattccctggatgccgttccgttccctacggagatcaatgtaatatgatactttgcaataatttttttcagtaaatctttggatgccttaatcttctgcggcgttgtaggagccgtcggataaatgacggttgtcccaagcactttcccagtctcatccactacagccagcttgcatcctgtacggaaagcaggatcccatcccagtacaacatgaccagcaatcggcggctgcatcagaagttgatggagattctttccgaatacctctatcgcaccgtcctccgccttctctgtcagctcattgcggatctcccgttcaatggccggcgcaatcagacgcttatagctgtcttccaccgcatccttcagcaccggtgaggtgtaaggattattctggcggattgttttcttttccagatagcggataatgtcttcctctggagcttctattttcactgtcagtattttttctttctcaccgcggtttaatgcgagtatgcggtgtcccaccagtttcgaaaccggctcctcaaattcataatacatctcatagactgactccgcctcgggatccttggccgaagaaaccagctttcctttctgtgccgtgatttttcggatccagctcctgtaatctgcttcatcagatatggattccgcaataatatcctttgcccctgcgatagcttcctctgcggagatgactcctttctcctcagaaatatatttctcggctgccttttccagaggttccttagcctgctgcagcataatcactgctgccagcggctccagccccttctcctttgctatcgtggcacgtgttcttctctttggccgatacgggcggtacaaatcttccactaccaccagcgtctctgccgccaatatctgcgcttttagttccgccgtcagttttccctgctcctctatactggatagcacctgttcctttttctcttccagattccgaagataaatcaatctttcgtgcagctttcgcagctgctcatcatccagcgaacctgttgcctctttcctgtatcttgaaataaagggaatggtgtttccctcatcaattaagttaaccgccgcatccacctgccagcgttttactcctaattcctctgtcagtttctgattaatatccatatagtccgtacctctctttttactcctgcagtttggcctcaaagaaccacaactctttttattatacaggaaagaccgccttttttacaacattttctctttcttttcacaccttattatggaaaacttccgtaacagttcaggacttcctgaactgttacaaacttccggcaaaaaccaccaaaattggatataattttttagcattactcccccactaaatatcttgcaacaaaatagtttacgcattataataatagaggttaatttaaaaagacagaggatgtgtaaaatgaaaaaaatactatcaacgataaaaaacttcttccgtggattcggaacactgctggcagtcatattaagcacgactgccacactgctttgcttcagtattatatggatgttccagacctggagcaacctgtcaatggatgaactcatgtaccatttgacagcccctctggagggtactaatgagagtatgattcaggagtacttaaactcctgcgcagtccctgcaattctaattctatttctcgtcgtaattctttttaccggattcagaaaaaagaaaaaagtatacaatatcatcatggcaatctgtattattgtacctctgctcgcagcaggaacgtctgtcagctatgcctgggacaatctggatgttggaacctatgtagcggatcaaggggtttactcctcatttatcgatgacaactacatcgatcccagagatacggagattacttttcctgagcaaaaaaggaatttgatatacatatttttggaatctatggaaacaacctatgcagacaaagaaaatgggggggcatttgaacaaaatgtaattcctgaattaacgtcactggcacaggaaaacgaagatttttcgggaatttcatctgagttaaacggcggatatgcaatgcctggcgctacatggactattgcggcgatgttctcacagtcatcaggtatcccactaagtatatctattgagtctaattccatggacacacagaactcattttttgctaatacaataactctgggggacattttggaacaggagggctattctcagaccttaatgataggctctgatgccgtttttgggggcaggcagctgtactataccgaacatggcaatttcgacattctagattatgaatatgcaaaaaaagccggctggattcccgaagattaccgtgtatggtggggatatgaagatcataaactatttcagttcgcagaggataaactgctggaactttcagagcaggatactccttttaatttaacactgctaactgttgacacccattttgaagatggttttccatgtgaagtctgcccagatacatttggtgacgatcaatatgcaaatgttatggcctgctccagcaaacaggtagctgattttgtttcctggattcagaatcaaagtttttacgaaaatacaacaatcgtgattgccggtgaccatcctacaatggacagtgatttctgccaggatattgacgacagttatacccgtaaggtctatacaacctatattaaccccgcagtacagaatacgacttcagatacacgcaactacactacatttgataattttccaacgacccttgccagcataggtgctacaattaacggagaccgtttaggccttggtacaaatcttttctccgaaaagccgacattgaccgaacgcttcggagttgataccatgaaaaaagagctttcccgtaagtctcagttaatggaagaacttgctgacctggatgaaagcaaacccgaactcctgatcagagaaggaaaggctccaaaagccgcagtcagtatcggcgagtatgattataatttaaataccttccccgtcaatgtaagcaatcttgagaatgttccagatggcgtcgaatccatgctggctgccatatggactgaggaagaccaaaacgatctgcagtggattccaatggatcaacaagaggacggaagctatcatatcgatgtggacatatcaacatacaactataaaactggcgactaccaggtacatatatatatgagagatgttcatggcgatctgtactttatgactcagacaactgcatttattaactaagaaaagtgggcaagtgtctcatccctgaggcctcttgcccacttttcgtaccaccgcaatgaggattagccctattattaggccctatcacggtcttttcttaataaacttccgatccgaacggcatcagcgccagctttgcaagtttaaattgctgcatgccaaacggaattcctacaattgtcacacagagcagtgccccgatcaccgcggactcaatggccagcggaatccctgatacaatcatccagataatatttaaaagcatagatcctgcgccgccgccatagtgtacttctttcccaaatgggaaaaagctcagagccgcgaacttaaagcactgcattccaacaggcattcccacaatcgtaatgcaccacaggcatcctgcaaacgcccagctcagaccactgataaatcctccaaatataaaccataatacatttcctatacatcccattaacgttcggcctcctttccaagcatcagctgtttttcccatttctgcaggttttctaccattccttccacctgcggaattgcgttctctaattcttcctttgcatcgtttatcctcgactggaccagccagtcagcgataataccatcgaagaagaagtcggcaaatgtaaggaaatccgagatttctacgcccagatgatatggtagctccacatctttcaattcacactggaatatctgaagctgaaactttgcatcctgtagtttttcctgggcgtcatccagcttggagtgtttgatcatatctacaaaaagacctccaccaagcatatcccatactccccagtttccggcgctgcttaaagtctctttagccgccttcatgctgttcagagccttctttcctgcgataatcgcctcattcatctccactacattttccttttctctcatcattagaatctcctttctggtgccctttttatgcagcagatagttcatcatctataacggtccacgggaacagcggattgtatccttgaaaccttatgtcttataaaagtaaaaaagacctttatatacgacatatctgccgcaataaaagtcttgcacatctcatttgatacggatacctctcgatatcgtgtgacgatttcaaacccacctctcggtgttcggctactcccttttacttgcttgttaagaatataacatgtttccctaatattgtcaacgaagcacctaaattcttttcttaagatttctttagaaatcggaatttagtcggcaagctttagacttgtcgacggacggggacgcttcatgacagggaggccgggaaggcgctggggctgtatatgccgttgcgatatgcacccatgctgctaagtgattctagaacagccgatgccggatagacgggtacgctgaacacatcacgggaaatctgatgatttcccgcgctgggttcagcaaaaacttgatttggagatcaagtttttccccgcctatccggaatcggctgttcaagaatcactaagcgcactccagcatatcgcaacggcatatacagccccagcacctccccggcctccctgtcataaagctggctcatccaatcggcaggaaagctcgccaaccgggtgggatcccggaccggagcagcggatgtggattggctatgcgtatcttttcatcttcaagatgtgtattgaattattttgatactggaaccgtatcccattgtttatgtacacctactggggacataatagtcccaccaattcaataccatacgctgcccccgtttgaggccccaccttagaaacgagctttttcctgccggttggatgcgccagctccatgaagggatagctgaaagcctcccggagaacatccatgtcctttcaaaaacgctcaaagcggaccttagaaattcttggtgggaaacagccctgaaaatggagagatttttggattccgaatccaaaaatcagctgacccagcgcgagaaatcatcggatttctcgtgatgtgtcagtggtgctccattttcagggctgtttcccgcctagaatttcttaggtccgcggccgcgtttttgaaaggacatggatgttctccgggaggctttcggctatccctttatggagcatccccatccgcgccgagactaaagctcgccactaaatcctgatttatagtgcatttttctttcggacttgctatactatatcggtaagcttaaagataaacaggagtacatctatggacagaatgttaaactataccattcagaaagacgaagacggtctccgcgtggaacaatttctccgcagacgtggatattccaggcagaatctggtcgaattaaagaaaatgccccggagtattcttgtcaatggcggcccgcgccgcctgaatgagatacttactgatatggatacactaaccgtgcatatccaggaacacatctcctccctgcagatccctcctgttcgacttcccctggatattatttacgaggatgaggatatcattgtcattaataaaccggccggcatgcctgtacacccgtcaatcaataactataccaatactctggcaaacgggctggcgtggtattatcaggaacaagggaaaccttttatcttccgctgcaccaatcggcttgacagagatacttcgggactgaccattatagcaaagcatatgctcagctctaatatcttatccagaatgaccgtccgccatgaaatcaggcgggaatacctggctattgtacgtgggagcgtacagccggcggagggaacgatctccgcgcctctttccagaaagcctggttctgttattgaaagaaccgttgattttgatcatggcgaaagagcagttacccattatcatgtggtggaagaaacaaatgggcacagcctcgtctcacttttattagagacaggccgtacccatcagatccgcattcatatgaagtatcttggttttcctcttataggcgactatttgtataatcccgatatggagtatatgcaaaggcaggccctgcattcctgccgtctggccttaaaccatccgattaccggggaaaaactggagtttcgtgcaccgcttcctgaggacatgcagagtgtgtttcctctatttcgctccggattctcttcctgtacaccagtggtgtgatcccatagcgttttgcaaacacacgtataaagtatgaaacatcctggtatccggtccgctcgctaatctcagaaatgctccaatcctgctcagccagcatgcgggccgcgtattcagtccgcttcagattcagatactgtgtaaccgtgtaccctgtatgcattttaaagtaatgcataaaataatacctattgtatcccgtaaactgtgccagccgctcgactgacagcggttcactgtaatgctcttcaataaaccggatcagccttttcatctgttctatctctttgattgtgctgcagcctgccgattcccggtaatgcttcgcttcaaacaatgccgccagcatctgtgtcagataccccttgatatataattcatatccatcgtcctgtttgttccacttctccagcacttgatcaaataagatcgccgtttccctgtaaagcggagtgcctggttcgataattggtatgatctttattgtctgattaagcatgggggaaagataacgtttggcaattttatctttcaaacttcccatcatcatttcgacatccgccagtatcactttacaaatcaacggattcgtttctgctccgataccaccgtgaaggctgctgggagaaactacaattaaatccccttttaccgttttatagtccttcaggtctatagtcagtaccccctccccctccaacacatagataaactctatatactgatgccagtgcaggagcagacggtgttcctgtatatctaccgtattatcaagaactgatactgccagttcgaaagaattataatttcgttcctcttttattgcccccctcattgcttcgcccctccgcacatttatctgatttttagccactttaatacgagaattttctcttgaacactattataatcaaattataccggtaatgcaatttgattcccttttttctgtattctatttcctatattggaggctgttatgaactcatatgaacgtgtatttgcaagattaaatggagaacctgttgaccgtattcccaacctctgccttgtcatgactttcgcggcgcacgagattgaggttccgtacagacagtttataacggactaccggcttctcgctgaaggaatgctcagatgctgtgaaaaataccatttggacgtgttgagtgtctgctccgatcccatgcgtgaagcaagcggattcggtgcagaggttgtctaccccgaaaacgatgtgccatacagcccggttcctctgctctcaggctgtcaggatatctcccgtctgaaagtaaaagctcctgcttccagcagacgtatgaatgaccggttggaggcggtgcggcttctaaaacaccgcagcggaggcgagatcccaattgtaggctgggtggagggtgcacttgcagaaagttgtgatttgatggaaatctccagctgcctgtgcgaaatgctggatgaaccggaagcaatgcatgagcttctggcaatctgcctggagcagagcatcctgtttgccctggagcagttgaatgcgggagccgacatcattggcatcggtgatgccgcatcgtctctcattggccctgatctctatcgcgaatttgcccttccatatcaacagaaacttatttctgagattcacagggcagggggaaaggcaaaactgcatatctgcggggacattacccctgtactgcatctggctgcacagacaggggccgatattattgacctcgatcatatggtagatcttaaaaaagcgtgtggcatatttcctgaaaccagctgcccaaacggcaactttgaccctgtgcagatcctgcttcagggagatatcaattcagtaggccatgcggtaagggaatgtctggcgtgtgccggcatgcaccgcacaatgatttccgccggatgtgaggtgcctgcctttacaccgcctgataatttgagagaagtccatcatgtactttccacatactaataagatcccccgaaagaattttatgattgttttatactagtataagacaagctaaatacctaactgtttcgctggcctgatttttatgataattcttatgcattttttctctgatatacggaaagccccgcatatagtaaaaaccatgctgtacaatggattgttaggattagtatatcgttcatcactgttgttgttttcccaattgaccaattcataatcccctcaaaagcagcctgtgagggcatgatatagcaaactgcggttagagccggatcgctgattccgagaagaaagtgcaggatgggtatggcgataaatagcagcattacgattttaatataaactacgccaaccatcagcccatccgaaaaccggccgataaacaggccgataagtgcagccacaaacgaggagaggacaatcagcaccagcatgagaactgcattttgcagggaaagccgaaagcaaatacaggcagtaatgattgaggataagcagccacaaataaatccaaccgtaaccttctgcataatataacggcttcgggccatgggtaagatttcgttgacaagtgccacgccatcctctttttcagaaatcatattcatagcattgaaggtacatcccataaacattgcgacaattaatatcgtggtgataaacatgtcctgatacccagccatgatatcggggcgttctaagatctgtatctctgcctggcctgctgattcccgcaatttgatcagtgccggaagtgtttcagcggtttgccggaatatatccagttcgtcaccggatagtaatgttttgatgctatttcccgctgcttccacaccaatcaggtttgtagagggctcattgaccccctgaatcagctcttcctcagtcggataaactgtcactgcgccataccgttccagcgggctaaaaggcttcgtcatataatcatctgcgccaaactcatacccccttagcttatcatcatcgctgctctttgccgtaagcatgataatcggcaggctgctcatctgtctggctgtcctgcagacggaaaatccatccagatggggaatcatcacatctaatatcataagatccactgcctgattctttaagactaccagggcatctacgtctatctttccctgaagaccgtgaatagtaaatcaaagcagtaaatcaaagaagacatcggcagaccattttagttcctgtttttgtgtaactcctgtcttatgtcttctcctcatacttctttctataattccttggagacattcccatatgtttcttaaagcaattagaaaaatatatctccgaactgaaaccgaccagttttgaaatcttcttgatgtcataatctgaccggatcagatactgtctggcatattccatccgtatctccagtaaaacatccaaaggagtttttccgaatgtttctttcattgccttagcaagataattgctgtgcagatggaactgttcctccaggtgttggttggtgatcggctgctctatgttattttccaagtagatctgaatctgttccgccaacagcgtcagccggtctttatggatcccggtattctcaacaaatcttaaaaaccgtaaaaaccgttcttctgttttccatatgtcatttccatgttcctggatagtactgtccaggatgttctgaaacagttcaaacagaagaccgggttctttgatcgctgcatatttgggcaggtgtaatgtgtatgagcattggtggtaatgctggtcggggattggcagccttgaaacgaatctgctggccctctgtccctgcttccactgcgcagtggtataaaaatgcagccagtaaaacccggtctcctcctggcatggctgccatgaataatggtgcctgtccggcagcaaaataaacatttcattttccctgatctcataccgctcattctcttctgccagaaacagacagcccttttctacaacgaccagatcaaaatagcccaggttcctcctgtctacatggctctgccctttcctcatggtgcggtagtttccctctataaagtccggaaatggtggaattgaaatggaaataatgtcgccggccatatgcttatcccctttcttttttcaaaataatgcttctcaggtcttttttatcctctatctggattataccatttcctgagataaaataaaattctttactgtatggggcaaagcttgtaatctgatactcggtttcgttctcttcataacttccattgattacgtggatggagtttcctttttccataatgaaagtcttatccccgaaattctccagatatgcggccatttcttcgcccatatcccagtccggggactggctgtcattttcaaaaagcctggaaaaaataccgccgttcttataaaatgtggattggccgaaccgtgccctggaaagatccgggcggttgatatgagggcctgccactgcatatgtggaagccgccattcctttttctaatggagaagttgccgtggcgtgcgtgtcataacagtacaggatgcctgccgtggccctatagcttgcttccagatatcttgtatccttcagatacaaaaaaactttatatgctgccgcagctgtaaccccaccccaaagggaatggatcatatacgtcagcgcttcccaccagcgatccgggttctgggccctgaaatcattggaatagccaatattggccaaaaggagttccccatagcgcctggtactctcccctctgttgctttcacatagagcgcctgctgtcggaccaaagcctgcgttatcataaaagtgctccgtgattgcggctttataagttaccgcctccttttccaccctgtccatgacctgttcccataaagattgtatctttgcatatttctctgtcatgccttttactttcagtttatccagcaattgattggaatacaggaaatatacgcctaacatctgtgattcttcttttccacgctcctcctgatgcagatcggggttcacccttaactcaaaaacgtccgccgcccattccaggtacgtacctgcatcatgcagtgcaagaacctcatccccaaactcggataacagataaaacagatggctaatatattcaaaatccatacagcggtaaaaatcaccataaagtttacgaggttttctaaaatttccgtctacaaaccattttttacggacataatttaccgcgcagttttccactttcctaacctgtccaacatccggcgtaccgaacagatttttcttcagaaccagatttgcttttccaagagattccccttgattggaaatcggctcgaaagcataaggaggttgcccattttcgtcatggtaaaggctgctgcaaatatattccacgcgttcttcaatcaccgtttctatcctgtccatcacattcattaccacaaagtcttctgtaccgtcagaaagcgttataactactttgtgctcccccattgcctcaggcttgaaaaaaagaccgtattgcctctttttctccgtttcccgtatcgggattgtaagtttctttacgattccatcatttttgtaaagagcatctgctgctattacatccaccccctctggtactcttacggatacccttgcgttttctccaataatatttaggggcgtgtactccagcttgggatgtttccatttcagccctttgttataaaaatcctcgggactttgattcgtatcgatcacgtactcccataccttattttcgcctgcttcaaggacaaatccgtccttttcgtatatccagtcatgattttcaaacttatccggatatccgcctgcaagatacaatttatggaacaacatgccgtctaaagaaggggacacattttcgaaaaacaaattccgataatcacaataagtaccgattgattttgcccttccctttacctgataaaatccgagattctctcccaatccatcccttcgcactgcacttagtttcgtatagtccgttgaaacagacgggaagactgcggcagaattatgtatattcctaagcacatttttatcccgaaacatcacataggcaaaggatacccatacaccgaactcttcgatcttaatctctttttccgtcaggttctttagctgtatggaccagaaaagcgcctccttatcctttcccaggtcataagccatcttcacctgaaatcctttggcattaaaggtaactgttatcttatctttttcttcctctatgatggacatgagcgcgttactgccctcctttttaccatccacaacaatgtcaaaataaccaaacagtttgtccgcatcctgataatctgcctgctgtaaataactgtcttctatcacccagttcatctgatgtggatcatcttttatgactaatgcagatacataaccttctttttccactgacatcctcagttttttattttctatcataagtaatccgctcctttcttatgtaaatttaacacttcagttcttgcctttctacatgaaatcccaatcaaaacttaataaatttcacactctttgttcctgatgattctctcataaaaataatatgtgcacattcgacaaaaagcatttgacatatttaccttgtatttatatcctgtctgcgatcttatttttctaaacactttcattccattttaagcttctattctcctatttatcagttagtatatatccaatctagaaagcaaaaggcacctcaatcctgctacttacaaaggattgaggtgccttacacaaatgccgcagaccggaattgaaccgtttcaaataatcacaaatactgatagaaaggggctttgaagacttcatcacggtctcgatgttcaaaaagtgttcaaatatttccaccctcaaactgggatttgtatttaaccttctatggtaccatcacaatcatcttcatcagaatcaattgtttctccacagttagtacatgcccattcatcatcccaatacataacaccaccacagtttggacaattcttaaacggtctttcgctcgtatctcttactaattcgccagaacaatatggacattttgagtattcggattcatcgtaaacttcatcacaccaaggacacatttgcatggttatcacctcctatacatacaaaaattatatcatgcgttataaaaatacaatagagaaatgtgatttaccaaatatacaaattctagtttgtccagtttccactactcacagtataattctattttataaaaatgcacaagcaaaaaaggcatgagagacttccttatctctgcatacccctttattcactccatgccattaacagcaacactccactattcttttacatagataattaattctcccttttatctgtttatccgtgtaggcgagactaaggcaatacgctgggaagatattgattatgacaacagaatcgtttatttacatagacaggccacctgtgaacgtacactaaacgatgatttatccttttcctaaagaaaagtaaaagtagtgaatcagatgaaagggaatacttctcatggttttcgcaagcaatacctgacagatgaagcaataaaaatttttcacaaagtaaaagaattaaacccaaacggagcatatgtttttgaaccagacggcaaaattatgactacagatagctttaaccgtcgtttaaagaagctggcgttctttatcattcgagtcataaaatccgcttctacaacgcttcaactgcttttgaaggaaacaatctcacaaccctcagttatttaatggggcatagtgaaacagcgccaacacttcactacctacggaacgtcaacaaagggaaaaatgatgtacttgcttttcaaaaacttggtatttcatcataaagtgttcaaaggtgttcaaacttttagacacaaaaaaataagagaaactctgtaaatccaacatttctctcacttttacttaatgccgcagaccggaatcgaaccgttttacttaatctcaaatactgatagaaaggggctttgaagacttcatcacggttgcggtgttcaaaaagtgttcaaacgtttgttgcatacaaactggaagttatctttttcctaatggcaatgctattaaatttcccaataatgcaataacagcatatccaactacataaacccatgcacttgagttataaaatataaatatagatggcgcaaacattattgctacaatcaaaatataccagaagttaaaaccattcctaatcccataaaaaacagaggttattaaacatattagaggaataattactaacataacaatcattgcacttcctgtgttttttataaaccaaggaacgatataaaaatctatcagcaacagtaggtagaaaaccatgttcttttttaatttatccatcatatcatcatcctttcaaattccgatttgtctgtttcatgttatacacagtataattccattttataaaatattcaattaaaaaggtatgcgaatattttttatttccgcatacccattatcactttattcttttacatatcgaattaactcaccaatttcacattcaaaatagttgcatagtttacagattaaatttgcatccaatctttgaaattcatttctgcaatatctattgaaatttgacctcggtatgtcaagttccttacaaatcgtattcttactgatacctttttcttgtaacagttcttctatccttaattctaaatgtccatagttcatgttctgcacctctacataaagtagatttattaaatctttatgtggtaattcactatatagtgaggtactatatagttatccctctactaataacacgaaagaggtatgtacatgaaaaagaaaatcatagcaccaatcacaatactctgtttactgaccattctctacaattatctcagactgccggactaccatattactaacagcatgtcctttagcagtgcagataccagagatactgaattgactgtaattgtttacaaatgttggggaattgatggagtaatcaaagacattgaaaacgaacataacaaaattaacggtacacctaccaccttggaaatcaacctctattatccaacttattacttgcacaataatagcaagccgttccgaactgtaaccattgaatataataaaaaggaatagcactctattactgcttttgaagtagtatcagctattccctctccttatattcttttgttcgtattttcgcaaactaacgttccgcaaggatgcccagtgcgacggttcctaacagggcggcgggtcgactgggcaagtggtcggctgagaagcattttctactcaacgacatatttaacgtttgattctctccgtccctcatatttctcctgtgccaacagtttatcaagaaattctgacacttcttccatgtcttcactgtctatcaaatccagttttatcaatacatcaaggtctgtctgattcttcggttgtattgagatcggctgagatgtatccacaaccactttcaactgttttgtcttatttgctgtttcaatatccgtagttaatcccataacgtggcttttactcacgccgaatatctgtgataatttttcccatatagattcatctctcggcgttccgtttccattttcatagttcgtaagcatactttgtgaaatgcctaattcttttgcaagttccgcaacggttatattcttttctttccgcaattcttttattttattcatagcgaacctcctttataagcacattatatttcatcaaattttctccgtcaatctttttatcggatattcagatattttctattgacattctgcaatgcttgttttatcataagattatcttaatatctgataatcagatatctataaggaggtgaaacgatgattagaggaaatgactttattttaaatccagacaaactgcaagaggaatttcagttagtagaagtttctgactgggtagacttttctacaaaagaaaaattaggattctactatacagttcttcttccaaaattaaagtttgaaaaagtcaaagtaggcattaaagctaacacagcgattgttaccaacgaagaacttgaacaaaaagggcagattccagtctcatttgatggattacatacttgggctagtctctataatggacgtctttctgtcaaagcagaagcttccaatatcagaaaagtgggaatgaaataatttccctactatgtcagccagtcagtaccggacaacgtcataggtgctgaactagctgacctctatacttgatatataaaacaacatcttccgaaaacaatcggaacattcattacaaaaattgggatatgaggtgagattcgtgagcaaaacaaaagagtgttttgcatacaatacgaaaatcattgaaactcctactacaaaagaagtatatatttacgaaaaccctatttttattcactcaaaagaaaaggctgatttaacagacacaaataaacgaaaaaactttgatgaaatgtcagctcataagcaatatgacagtttaaaacgcaagcagaagcattacgaacaggctcgttgggatattgcccgtattgttgactgcaactttgataacaaaacaaaatttgtaacgctgacatttaaagaaaacattcaggaaatcctgataactaaccgagaatttaagtattttatccagcgattaaattattatttgtaccataccaaaacccagttattaaaataccttgcaacgtgggagaaacagaagcgtggagcaatccattatcatgttattttctttgattttccgtatatagcaaaagaaaaattacagaatttatggtcacatggatttattaaaatcaatcgcattgatgtagacagcaaagaaaacagaggtcgttatcttagcaagtattttggaaaagaccttgatttgaaagaacataagaaaaaagccttttttaaatctcaaaatctgaaagttccacacgaaacaaaagtcatgctgaccgaaggcattttacatgacttacaaaaagaaaatatcgtctttcagaaagaatacacaaggcaaatttacgataccaacgctttcttatctactggttcatgcttaaaggacagcagtgttatctacatcaaaattaaaaaagaaaatccttgcgtaaagggggaatcttatggataatcccgttacgttttcagatataacattattgaatacgttagccacctgtgctaacatgaccacagatgaagtcttcaaagattttaaaattatggcaaataaaaaaatcttgaagaatcacaaatatgaaatttattactcggaatcagaaaaaagctggcgtacttatttacccgatgaaaccaaacctaacaaacgccgtcctgttaagaggaagagtaaagagaaccttgaaaaagaaatcatcagattttatatcgaaaagcagaaagctgaaaaccgtcagaatgtcacactagaagaattatatgctgaatggcttttgtataaaagagattatacttccgtaaaagcaaaaacaattcaagaatatgtatctgaatggaatagatttttcaaagatacagaacttgttaaaatgaagataggcgaaatcaaaccaatcacgcttatccgctttttcagagaagctacaaaagaccgacagttcactcacaagcgagtcagtaatgcccgttctgttttgaatggaataatgagttatgcgatcgaagaagaaattatatcacataatcctgtctctgatgtgaatttcaaacagtttacctataagccagtagaagtacaaagtgacaatgtattttcccgtgatgatacgcataagttattaaattatcttcggtgtatcatagagccatattctcttgcaatacagttatctttttatctgtttatccgtgttggagaaacaaaagctatccgttgggaagatattgactacaataacaggcttgtatatcttcacagacaggcgacctgtgaacgtacattgaatgatgatttaacattctcaagccgaaaagtaaaagtagtaaatcaaatgaaaggaaatacttctcatggattccgtaaacagttccttacagacgaagcacttaaaattcttcacaaagcaaaggaattaaatccaaatggaatatatgtctttgaacctaacggtgagattatgacaacagacagctttaaccgccgtttgaagaaatattgtaaagaagccggtgttccttatcattccagtcataaaatccgcttttacaatgcttcaacagcttttgacggaaataatcttacaacccttagttatttaatgggacatagtgagacagctacaacattgcattacttgcggaatgtcaataagaggaagaatgacaggcttgcttttcagaatcttggtatttcatcataaagtgttcaaaggtgttcaaactttttgaagcaaaaaaataagagaaacgctgtaaattcaacgtttctcctactttttactaatgccgcagaccggaatcgaaccggtacgggtatcactacccacgggattttaagtcccgggcgtctgccagttccgccactgcggcataatatatgggacctatagggctcgaacctatgaccctctgcttgtaaggcagatgctctcccagctgagctaagatcccataatatttacttgtacatcggagataattataactctttttcactctaatgtcaacgacccagaagagactcgaactctcgacctccgccgtgacagggcggcgctctaaccaactgagccactgggccttattaatttctttaaaatagtggaccttcggggactcgaacccaggaccgatcggttatgagccgattgctctaaccaactgagctaaaggtccacgtgtattatgtcccaaaaaggaacaaagccgatgatcggactcgaaccgataacctgctgattacaaatcagctgctctgccaattgagccacatcggcataaataaaatactgaccaaacattaaatgtccggtataaaatgactcctacgggaatcgaacccgtgttaccgccgtgaaagggcgatgtcttaaccgcttgaccaaggagccgcataaaatcatatataaaattttatagaccgtaagtagtgctcacggtctacaagctccccgagttgggctcgaaccaacgacccttcggttaacagccgaatgctctaccactgagctatcgaggaatatgatactatatctgtgtaccttcaaaactgcatacaaagaattaaatccatccattatcctatcaccttgcttggttatgccctcgacctattagtaacagtcagctccatgtgttgccacacttccacctctgccctatctacctcgtcgtcttcaaggggtcttactaacttgacgttatgggatatctcatcttgaggggggcttcacgcttagatgccttcagcgtttatcccttcccggcttggctactctgctatgctcttggcagaacaacagatacaccagcggccagtccaacccggtcctctcgtactaaggtcagctcctctcaaatatcctacgcccacgccggatagggaccgaactgtctcacgacgttctgaacccagctcgcgtaccgctttaatgggcgaacagcccaacccttgggacctacttcagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcgcagtcaagccttcttctgcctttgcactctgcgaatggtttccaaccattctgagaagacctttgagcgcctccgataccctttcggaggcgaccgccccagtcaaactccccacctgacattgtcccccagccggatcacggctgatggttagaaacccaatactgcaagggtggtatcccaacagcggctcccttacgactggcgtcataagttctcagcctcccacctatcctgtacatgcaataccgaatcccagtatcaagctggagtaaagctccatggggtctttccgtcctggcgcaggtaaccagcatcttcactggtacttcaatttcaccgggtgcattgttgagacagtgcccaaatcattacgcctttcgtgcgggtcggaacttacccgacaaggaatttcgctaccttaggaccgttatagttacggccgccgtttactggggcttaagttcaaagcttcgcttgcgctaacctctccccttaaccttccagcaccgggcaggcgtcagcccatatacctcacctttcggttttgcatagacctgtgtttttgctaaacagttgcttgggccaattctctgcggcctctcgcgaggcaccccttctcccgaagttacggggtcattttgccgagttccttaacaatgcttctcccgtcggccttaggattctctcctcatccacctgtgtcggtttacggtacgggttttaactgaacaatagcggcttttcttggcagctagctcacgcacttcgctactttagttcgctccgcatcacgtcttcggattgcataccggatttgcctgatatgctcctaccacgcttgcaccggattttccacttccggcttgcgctttctctctgcgtccccacagttctgtcagttaaaagtacaggaatttcaacctgttgtccatcgactacgtctttcgacctcgccttaggccccgacttacccagagcagatcagctttactctggaaaccttagatattcggccggaaggattcccaccttcctctcgctactcattccggcattctctcttcttaacactccactgctccttacggtacagcttcgccgcagttaagaatgctcctctaccaattgacattcatcaattcctaagcttcggcagtgtgtttcagccccggacattttcggcgcaggacctctcgactagtgagctattacgcactctttcaatggatggctgcttctgagccaacatcctagttgtcttcgaaatcccacatccttttccacttaacacacattttgggaccttagctgtaggtctgggctctttcccttttgaccatccaacttatctcggacagtctgactcccatacatcatctacacggcattcggagtttgatattctttggtaagctttgacgccccctaggaaattcagtgctctacctccgcaagacttgagtatgaggctagccctaaagctatttcgaggagaaccagctatctccgggttcgattggaatttctcccctatccacacctcatccccacccttttcaacggatgtgggttcggtcctccattgccttttacggcaacttcaacctggacatggatagatcacccggtttcgggtctactccgactgactatattcgccctattcagacttggtttcccttcggctccgggccttcggcccttaacctcgccagccagcgtaactcgccggaccgttctacaaaaagtacgcggttgcacatataaagtgctcccacagtttgtaaacatatggtttcaggttctctttcactcccctcccggggtccttttcacctttccttcacagtactatgcgctatcggtcactaaggagtatttagccttacggggtggtccccgcttcttcccacaaggtttctcgtgtctcgtggtactctggataccgccatgtcatgttggattttgcttacggggctttcaccctctctggccagctttcccaaaactgttctgctatcttccatgaatcaattatgcggtccgaaccccagggtgcacgcaccctggtttgggctcttccggtttcgctcgccgctacttccggaatcacatgttgttttctcttcctccggctacttagatgtttcagttcaccgggttcccttccttaacttatggattgggttaaggatactggaggtctgctccagtgggtttccccattcagaaatctccggatcgatgggtatttgcccctccccgaagcttatcgcagcttatcacgtctttcatcggctcttagtgccaaggcatccaccatacgctcttattagcataaccaacttgccttctctcacgggttggagatcgggcgacacatatctagcgtgatatgcgttggcaataggttcctcttattgaactgctaatgttcaataaaattcaattttttccgttcgtttttttcgaactagttaatgttgttaacattacctcggatgtcttgattaatatcttatcgaatgacatttaatatgaatatcttattgaatgtctttcaataagcataagatatttaatctgttatattatcgcttatctgtaataatataacttttctttgtatgcaattttcaaggtacacatttgattctttgcagaatcaagtggagaatacgagattcgaactcgtgacctcctgcttgcaaggcaggcgctctcccaactgagctaatcccccataatttcaataccatattttattgtttagatatgggcttaagtggactcgaaccaccgacctcacgcttatcaggcgtgcgctctaaccggctgagctataagcccatattctttttaaatttggcggccacctactctcccacatcgtctccaatgcagtaccatcggccgtctgggtcttaaccatcgtgttcgggatgggaacgggtgtttcccccaggcgcatcgccaccaaaatatttcgttatgtgagcatgcccttgcaggcactctcttgataactaaacaatagacaacatactctttacttctttcttccttagaaaggaggtgatccagccgcaccttccgatacggctaccttgttacgacttcaccccagttatcggtcccaccttcggcagctccctccttacggttgggtcactgacttcgggcgttaccaactcccatggtgtgacgggcggtgtgtacaagacccgggaacgtattcaccgcgacattctgattcgcgattactagcgattccagcttcatgtagtcgagttgcagactacaatccgaactgagacgttatttttgggatttgctccacctcgcggcttcgcctccctttgtttacgccattgtagcacgtgtgtagccctgctcataaggggcatgatgatttgacgtcatccccaccttcctccaggttatccctggcagtctctctagagtgcccggccaaaccgctggctactaaagataagggttgcgctcgttgcgggacttaacccaacatctcacgacacgagctgacgacaaccatgcaccacctgtctcccctgtcccgaaggaaaggcaccattacgcgccggtcagggggatgtcaagagcaggtaaggttcttcgcgttgcttcgaattaaaccacatgctccaccgcttgtgcgggtccccgtcaattcctttgagtttcattcttgcgaacgtactccccaggtggcatacttattgcgtttgctgcggcaccgaatggctttgccacccgacacctagtatgcatcgtttacggcgtggactaccagggtatctaatcctgtttgctccccacgctttcgagcctcaacgtcagtcatcgtccagtaagccgccttcgccactggtgttcctcctaatatctacgcatttcaccgctacactaggaattccacttacctctccgacactctagttacatagtttccaatgcagtcccggggttgagccccgggttttcacatcagacttacataaccgtctacgctccctttacacccagtaaatccggataacgcttgccccctacgtattaccgcggctgctggcacgtagttagccggggcttcttagtcaggtaccgtcattttcttccctgctgatagaagtttacataccgaaatacttcatccttcacgcggcgtcgctgcatcagggtttcccccattgtgcaatattccccactgctgcctcccgtaggagtttgggccgtgtctcagtcccaatgtggccggtcaccctctcaggtcggctactgatcgtcgccttggtaagccgttaccttaccaactagctaatcagacgcgggtccatctcataccaccggagtttttcccactgtaccatgcggtaccgtggtcttatgcggtattagcagtcatttctaactgttatccccctgtatgaggcaggttacccacgcgttactcacccgtccgccgctcagtcacaaaacctttcattccgaagaaatcaaagtaaagtgcttcgctcgacttgcatgtgttaagcacgccgccagcgttcatcctgagccaggatcaaactctcgttaaaagtgtttgtatccgggtcagaattaactactagctaattctatccctttttactgttcttaccaccgagattaatctcagtgatgggtgcatcattatgatgctgttcttaaaaattttctctataagaaattttcaagggtttgttgtctattgtttaattatcaaggtgctttgttctttttaagcgaacttccatattttaccatgtccgtcttgctttgtcaagaacttttttatttttctttatttctgtttgcctgtcctctctcgagtcagcttaaatatattagcattttctgtaccagtttgtcaagacattttttaaaacttttttacaaaattttcattctttcttaacatactcagatatgccgttctgtaactgccgaaaccatgtttcgccatgtaaacagaacaaacggagaaggagggatttgaaccctcgcgccgctactaacgacctactccctttccaggggagccccttcggccagcttgggtacttctccaaaacgtccgctattaaatatacacgaaaccagccctcttgtctagtccttttctatctttttttaattttcttctttttacattttatgcgataattttcagacattttatgtcatatatattgaggctctcgccgtcatactcttttagccgaaattctggccggacgtttgattaaatacacaaaccgtgagtacacctccttctaaatcagggcattttcgtaagatgttcctaacagccggacgttcagctatatatagaacccgtggacaacagggcatgattttgctcctgcttatatgccgcctctgcctgtcattgcttattcacgtattccatgaccgctttcagcgcaatcataaaccagggcgtataaagctccggattttcttggatatcagacatgagatctttcattttcacccatcttaccgtttccacttcctctggattttctgtccagccgcccctgtactctcctgccagcacatggtcaaattcaaactcagtcaatccgttttcaaatgtatagcgatagacaaaggactggatttcctccagatccgcggtttttattcccagctcttcctgaagacgcctgcaggctgcctgatatacactctcccccattctcggatgtgaacagcaggtattggtccataaaccgccgcagtgatatttttcttttgcacgcttctgcagcaatatttcgtcatccttaaacagaaatacggaaaacgcccggtgaagacgcccctcttcatgggctctcattttttccatacatccaagtttttggtcattcatgtccaccaggataacctgttcctgcaggatttcgtcctgagcccgctccgttccttcctgtaatctgatccgctgtttcccttccataagcctctccattccaccgcttctataatggcggttcattatcgtaaaatattttatctatatcttatcacattacaatggctggtgccagtcagctatttcttaaaaacagatcttctttaacaatttttcaaggagtacaccacagtttttcttcactaggctgatctgatccggagtgatgtcgtctacatgaattccgcatccgcagatcacagtgcagctctttctttttgccaggctctcggcaaaccatctggctatgtcttcatctttatgcccggttccattgattacactggaggtaactccaatgccctcaccggtcagactcggcctagctatcgccataaccacgcttccgatgtgcggtgtgtctccgccataaaccgccagtgagtaatcttttcccatctcaaccacatcacaatgcacataatatccgttaaataactcttgtctgagtacgctgtcattcatcctgcattcctacctttcctttccacggaacaaatttatcataggaaatcccaaactgtgccaaaatcttacctacgatatggttgatctggtcatcaatcgtctttggcccattataaaaagtcagcaccgggggaacaattgtgcatcctgcatccgccgcttctttcatattccttagctgaatgcggttcagcggcatttccctcggaaccaatataactttgcgcccctctttcaagcagacatctgctgcacggataatcagcgtatccgcatagccagctgcaattcccgcaagtgtcttcatactgcagggcatgacaatcatgccttctgtaacaaaagaaccgctggatatagatgctgccatatttctttcatcgtgaactacatcagcaagggcaagcagcttctccatgcggatttcgctctccagttcccatgttgcttttgcaccgctgctcaatactaaatgtatcttacatccctctacacttttcagcgcctgcatcaaatagtaactcatctctacacctgttgcacctgttactccaacaatgattctcatacctctacttcctcccttttttaatatcctgcttcttttatagaaataggtcggaaacttttcaagaagttccggcctatatcatatttataaaatttatccctttagttccggctcttttttttgaacacggatttccagcgcaggttcctgtcttataccaggccgactatattccaccagagtacttccactaatacaagaataaataccactacggtcagcggaacgccaagccggattgtttccttttgtgtatacattccgttttcttccccctgtcctactaacatgttcaggtgatggaacggaagtatatagtgtgatgcgattgccatatacacgatcagggctgtcacaagcggcggaattcccataggctgtgtaaagatcagcacagatgggatcacaacacccataactgcgataaccgaccccataaacatatgtaccaccatggagatcagcgcaatcagcaatgctaatacgaaaaggttgcttggcagatgctcaggcaaaatggtgtttgcgatccatgtattcataccggtcgctccgcccaccgtgccgattgccatagcagatgtaaggaataccaacacatgtaccggaacctgtccccaggacttcacggttagaacttctccgataagcgggaggctcatgcacattgcaacgcccattgttacccagccgatgtcgattccgtgaatcgagtcagtcatccacagtataattgcaattaccagccatattgcagtccttttctccagcttgctcattggaccctgagccttttgtttttcttcaatttcctggagatttatcgttaccggctgtgatggtttgaataaaatcagaatcagaaccagtgtaattacagatgcgacaatcgccggaatccccatatactggaaccatccaatccagcccacacttacactatcgcctgcataggaggctgccagtggattgatgacactgtcaccggtcaggaagatcaaagataccggcaccgatgccgcgaatacagtgaaaccgattttaactgcatctactttcgggatcttagcactttgaatcacaactgccataactgacataatcaggaacgctctcggccatggatgtggtatcagtacactcatgataaacgtcagcacaaaaatcgaaataataataccgttgtaagaccgcacaaatttcttgataaatgcatacgcaatacgttcgccaagaccggagtcctttaccgctcccgcaatcatatatgcccccataacaagccacatggtagaggaaccataccatgatttaaacacaagatcgggtgtcgcaaccttgcacacaatcagcataatcagataaaaaccacctacaaagcccgactgcgctacatttgttgcccaccatactacggtcattaaacttaatgccagacatctctgaccttctggttcaattccggataatggtaaaagcataattacaaccgctactgcaatacccgccagaaagcctatgactttcttgttcattagtagacccccttttactcatttaattttttatttaactattcttgtaactttatatcatgttcagccatatttaccagaaggcctgttctggtaatggaacaggccctctcgtcatttgatctcaaaacactttattaatcaagcggtggtaccggcggaataacctgtaattccgggatctcttccggatttaatttgaatttttcatgaatatcaggattttctgttgatctccatgaatagacacaagtttcacacacgtatacttcccatgcatctccaaccggagattttaccattactcttattttgtcactaccacaacgtggacaagtcatatcttctacctccttcaatattgcagacatccgctcctgcagatgatttgcatgccttttgtcttatttgaataattcgcgaagtttttcttcccactcacctgtttttgccggcggctcaagaagctctaccgcacgcggattcggctctggtgctactggtgttgtcgcatcaataatcatctttgtgtgcatacctgccggataagacgaaggatcaagaggcataccaggacaattcggtatgatggcaacatctttgtctggttttactctcgatgccattgcccacataacctgctccagattaaatggatccacatattcatctacaacaattacaatttttgtataaggcatgccatgcggtgtagataacagacggaatgcaataccttttccatatcctccataacggcatttggtagaaataattgcgatatgaccatgcatatacattgcgtttaatgcgaccagttccgggaatccttctttaatctgtttatataaaggtacggaagtattcagtgccatcagataatctatttctgtccaagggataccaagatacagattctcaaaaatcggatccgttcggtgtgtaatatgctcaatctttacaacacactgattacgtgctcctgagtatgagccggggaactcaccgaatggtccttccacttcacgtacgcggggttcaatataaccttccagaatgacctcacttcctgccggaacatagaggtgatcactcaaatcagcttttacaatgtcgatcggcactccatcctgaagcgcacctacaaactcatattcattttgcgtatatcctaccggtgtggaagccataaaggttaccagcgggttattgccaagcgcaattgcaatcggcactttctcatttttacgctcagccttttccagctgcactgcgatatcatgcatagccagggcctgaatgccaattctgtctttatctttcacctgaatacggtatgtacctacattcatcttgtcgaaattgcccggatcttccggatcagcagttacaaccgatgccttggagataaagaaaccgctgtcctgatcattgattctgtaaagtgggaggacttcaaacaggttaatatctttatccactacattttccttacatggagccgcgtctctttctacaatattgggcggtaccgggaatttatcccatctgcggttcagttcaaaaaactgttccttaaccggtgtgtcttttggcatgcccatcattaaagcatgatttggccatgaaccgtgaacgtttgttactaccttccctttataaccattgatgttttcgaataatacagccggcccgtttttgatatttgctgccgcacgtcctgcagatgcaatatctggctcaggcatcacttcttctttcactcgtaccagttgaccttcttcctccagggtcgccagaaattcccttaagtctttgtatacttttgccacgccttttcctccttacctattcgctgattaatttagaagcctcttgttacattttgttaatttagtccaacaaagcgcttttgtttacgagttaattataggttttttcaactgcaaaacgcaattcacatttctcccgagtattattccataatggaattgcaggttcatcaacgcatttagtataatatttaacaaatgagatgtgctctggattacccaacctataattcaggaatatcatgtcgaaatccgaatagactataaaataaaatcccgcatgaatcacggaggtgtggtatatgaccctttcacagatcatgtattttctcgcagttgtaaagtataaaacctttacacaggcaagcgacgaactgtacatatcccaatcttctttgtccaaacaaattaaagctctggaattggaacttggacacaccctttttattagagaggccaaagaaaactctttgactcccgcgggtgaacgctttttggaatatgcaactaaattttctaaagattattcctccatgatgtctgacctaaatcagatgaatggcaatttgtccaagacggctttaattttaggggtactccccattatcaacgaatatagcctgaacaacgatattgtttttttccaaaagctcattggctcctccaatatctatataaatctgctggaacgggaacaggaagaattgcagaatatgatgcagttcgggcagattgatgctgcgatcctccgcacagactcttttgacttgtccaaatatgaatatgtcacctatttggaggaagaactggttcttatatatcctgataagatggagcacttgaataaagagtatgttacattagaggagatcgccgaccatccgctcatttcctttgatgagtcttcctcactccacaccaccatcaagcaattattccatgaaagaaacctatattctagattttcttacctttataagcatcatgaacagatcctgtctatggtaaatgcgaattttggcgttgccgttataccgggcaatttagtgtccgccacagtgtttccaaacatcagggtggctcattttaagaaacctatcaaatcgaagatctgccttgtacgtccaaaaaaagtgccgtcatcggagcctttgaatctgctcttcaagtattttgaatctacttatcaagatatggacaaggattaattttctaaaatatcatacatgcaatgccgtcttacataaaaaagcccctgcatcaataaccgttccgtctcgaaccgttcattgatgcagagtcttcttttatttttatcttaaccgacagtttttatgaaaaaaaatagcagaaccgataaccttaccggattccactacccttagctaaaacggagagggtgggattcgaacccacgcgcccttgcggacaaacggttttcaagaccgcctcgttatgaccacttcgatacctctccagtctcttacctgcacctgcagaataagttcaattgtattgtcagctttcgcgacattggatattgtagcatatttatgaaatatatgtcaataacttttttataatttttcactgcgtcttttcagaaacacctcagccatctccaggtcttcaggagttgtgatctttatgttctcataggaaccataaaccaacctgatgggataccgcagcatctgctccacaaccatagcatcatccgtcacattgatatagctttccctcatcagcatagaatatgcacctcttactaaatgattttcaaaaacctggggagtctgcaccatccacagcttgcttctgtccggcgtcgtttctacattaccgtgttcatctgccatcttgatggtatcttttacaggcatgccgactacacaggccttgtgctcctgtacttcctcgtaagccctctcgatgattccacggtccacaaacggacgggctccgtcgtgaataaagacataaccatgttcctccagttcctgaaggccgttccagacagaatgatagcgttccgcgcctccgtgcatgatcctgcttacttttgtaaaatgatacggattgacgatgttctccctgcagtattcttcttcccctgctcccgttatcagaaaaacctcgtcaataagcggtgaatcttcgaaagctttcagagaataatagagtaccggacggtccccaagcagcagatactgcttgtgtacttttgttcccattctctttccctgccctgccgccagtacaatggcggtacaatgtgttttccccatatacacctcattcgttaccgcgtaccctttttgggtgtgcacatgaatcctctctcccctaacgttcccccagtttcagattcggcaccgcattcaaatcccagccatgcctggtccccgccagatattcataataggcggcggccccaatcatagcggcattatccgtacagtagatcggggagggataataaaattcgattccccgcttatcacaggcttccttcattccttccctgagggcgctgttggatgccacaccgccggcaatagcaaacttgttcatgctgtattcttccaccgcgttcatagagttttccaccagcacatccacgacagctttctggaaagaggccgcaatatctgccggattgtaggtctgtcctttcatctggcagccattgatataattcagaaccgcggatttcaggccgctgaaactgaaatcataaggtgcgccctctatatgagctcttggaaatttaactgcatccggatccccttcttttgccagccggtcaatcttcggccctcccgggtaacccaggccgatggccctcgctaccttatcataggcctctcctgccgcatcgtccctcgtacgtcctaaaatattatatttaccatattcttttacgcagacaagatgcgtatgcccgcccgacacaaccaggcataaaaacggcggttccaggctgtgatgttcaatataattcgcagaaatatgcccttctatatggtgtacgccgatcagaggaagcttctttgcataggcgattgccttagcctccgccactcccaccagaagagcgcccacaagtccagggccgtatgtcactccaaccgcatcgatatcatccagcgtcatattggcgtccttcaaagcctgttctattacctgattgatcttctcaatatgctttctggatgcaatctcgggcaccacaccgccatacagcttatgaagctcaatctgggatgaaatcacattcgacagcacttcacggccattgtttacaaccgcagccgcagtttcatcgcaagaactctcaattgcaagtatattaatatttcgaatttctttcataaatatgcctcctattacccgcttcaaggctgattctcagaaaatgccagttccgcagacattctgtccttaccgggcttcgccgccggaaagatctttcttacatcatccatatactcttccggcctggtaagggatggactgtagtgcgtcagccaaagttccctcacctgcgcttccctggccagttgtgccgcctcatagaaggtcatatgcttatattctatcgcttttgcagctttatctttttctccgtacatcccttcacatataaacagatccgaatcctttgcattttcccggatggactccgtcggtcttgtatctgttgtataagtaactttaatccctttacgcggagcgcccagaaccatatcgggcgtcagaatccttccgtccagttccacggtctctcccttttgcagcggattccagcattgcatcggtataccctgcgccttcgctctttctatgtcaaactttccggccctgtcgatctccagtgtatatccgtagcagagtacattatggttcacacggaatgccttcagacgataaccgttcatctcaaatatctgctgtgtcccttctatttctaaaaaacgaatcggaaacggaagctcaggcgctatgactctcagcgcattcacaaccctttccagtcctttagggccaatcagagtaaggggttccctccggtctgcatttcccatcgtgagaagcagtcccggaagcccgctgatatggtcgccgtgataatgtgtaaaacaaatgacgtcaatcggcttaaaactccagcctttttctttgatcgcaatctgtgtcccttctccgcagtctatcagcaggctgctgccgttaaatctcgtcatcagggcagtcagccaccgataaggaagcggcatcatgccgccgctcccgagtaaacatacatctaacatattatccctctatttctgccggtatctgaaatgatgcaaggagctcatcatagcaggattcacataaatcaaaagaatgtctctctccatccttattcgaaaagtatccccatgtatgatcaacactcaggatgccttcctccgcatgcccatttacgaccggtatttcttttccacatttattgcagataattttatttacttcttttgtctcttttacttgatactggcgcatacaaattcctcctgtgctgtgtaaattccacttttgttacgccttcattatatcggcttttgagctaatttcatactgggaagtgcttcctcaattaccgttactgtacacactcttcgtgtgcgcacagtaacggcatctgcacattaaaagtcgcctgcggcgaggtgcagatgccccggcctcatcactttataggctccgatgccgtgcagcaaggtgcacggcacggtctgaacaccgaccaattacctgccaagtttcctgctcatcaatacagcatcttccttcggggcatcgtaaaaattctgcctgatgccatcctccacaaacccctcctcttcatagaaggagcgtgccgccgcgttgctctcccgcacatccagaagtattttattgatttttctttcttcacatatattttccaatttcagcatcagatggctgcctgccccttgccgcctggattctttctccactgcaatgcggacaatctccgcttctcccgcagcctcgtaaaccagcatatatcctataagccttcccgccttttctgctgctatacagattgtctgcggttgattgatggtgtccagcacacttgtctcactccagggatccgaaaatatctgccgctccatctcagctgcagcagccgcatcctctgctctaagataccggacgatcagctcggcctgtttttcccgctctgcacgttcccgttcggcctgcgatacccggagatactccggctgatgctccccggcagtctccatctttccggccttgtaatactggatccccagggcccctactgctgctgcacgctggcggctcatatagggcggtgcaaaggaatacggcacctgaatatacttatcgatcacatctctgtgcacaggtacaccgtcccccaggaacaccaccggccttccatacgcattcagacggcgcagtagttcgtctatcgatacagccatctgcatcttaagcacctgaaagcagggttccacccaattggtgccctctttcctgcccgctttttttgaaaatgtatagattccggtatatacctgatttctgcgcgcgtccataatcggacatatgaggtcctcacatccgtagacctgatatgccaggccgtccaccgtaggaatgtgcagcaagggtttgtccagtgcaagccccagccctttcgccgttgcggatccgatacgcaggcccgtaaaagagcccggcccgcccgccactgcgattgcatctatggaagcaagatccagttccaccatctttaccacttcatcaatcataggcagaagcgtctgtgaatgggtctttttataatcaatcgtatattccgctatggtcctgtcctcctccactaccgccaccgtggcggtcagcccggagctgtcaattgccaatacccgcatgtcatacttcctctctattctataaaggggtaacagttcaggcaggcctgaactgttacataaaggggccagcacccgtctgcccccgtttgttatccctacatctcttcgatcgttattctgcgatattcaaatccctgttccagatctttttctataatcacttccgtacgattttccgggaggatctcttcaatcaggccggcccactcgatcagagagacgccctggcccataatataatcctcgtatcccacttcatccatctcctccacatcaccgatgcggtagacatcaaaatggtaaaacggcagacggccttccccgtattcctgaacgattgtaaaagtagggctgcacacaggctcctcaatcccaagccctttcgcaaatccctgggtaaatacggtcttgcccacaccaagatcgccggtcagagtatacacctgtcccggcttcgccttctgccccagcctgacgccgatttgaaatgtctgttcgggacttcttgattccagtaccatattctcccctctttcatgcttaatttacctgccggatccgaaccttgtctggcggcatgtgggtagagatcatctccgctgcagccgcccatttctctccgatctgatttcttggaaagataacggcacggcttttatccatatacagcacaagcgcctgccctgtggaaaccgcccgctgaaaatcctgccaggggttctcgttttcccggtcttcctgtatcactttgacaccgctgtcagtaagctcataacacaaaggctttttaaatacgggcgtattctccacccggcgttttgcgcgtatcctgagcataaccggcggatacgcaaatataagcgctgcgatgaaaaataacagcaccgcacccgcagtcttcccagactccgcctgcttcagccccgtcgccaaaatcacggtaccaaaaactacctccagtatcccggacagctgcgtataattatgatgcagcataaaactatacattgcctgcggcgtcattcgtatctcaaatctgactgacatagcccatcctttcaaacgattctaatgatggaacagacgcagtcctgtaaatgccatcgccatctgatgcctgttgcatgcctcgattacattgtcgtctctcactgatccacccggctgcgctacgtactttacgccgctcttgtaagcgcgctcgatattatcaccaaaggggaagaaggcatcagaaccaagcgccacaccagtgagcttatcaagccattcgcgcttctcttccctggtaaatacttctggtttttccttaaatgtattctcccagacgccgtcggctaggacatccatatattcctctccaatgtacagatcaatggcattgtctctgtctgcacgcctgatatcgtctttaaagggcagctccagtaccttcgggcactgacgcagccaccagttgtctgctttttgtcccgccagtcttgtacagtggatccgggactgctgccctgccccgatgccaattgcctgcccgtcttttacatagcatacggagttggactgtgtatacttcaacgtaatcatagaaatcgccagatccattttggccggttccggaatgtctttattctctgttactacattcgcaaagaattcatcatcaatcatcagttcatttctgccttgctcaaaagtaattccaaatacctctttacgctccaacggagccggaacgtagttcggatcaatctcgataacattataattgccattttttttctgctttaaaatctcaagagcttccggctcatatccgggtgcaattacaccgtctgacacttctctcttaatcagcctcgcggtgtccgcatcgcagacatcagacagggaaataaaatcgccaaaagaggacatcctgtcggctcccctcgctctcgcatatgcacatgccagaggggacagcttccccaggtcttctacccaataaatcttagccagtgtttcatccaaaggaagccctaccgcagcccctgccggagacacatgtttaaatgaggtggcagccggcaggccggtagccttcttcaattcactaaccagctgccagccattgaacgcatccagaaagttaatataacccgggcgtccgcaaagtaccttgatcggcagttcgctgccatcctccatatagattctggacggcttctgattcgggttacagccatatttcaattctaattcattcattatatccttcgctccttattgattcttatttacaatcttcgtctcgtatttcccggtctcgatatctatatagcgtacaaaaagagaaaccttgttgtcctcattcagactgttccacaaaagctccgtgaagcattcgatatcatccggaacagatatcagctttggctctccctcaaaactcggcagaggatttccatcacacatgtatgtatggataaaatgtccttctcccgccagaggattttcatacgcgaatgtatacctgctgcagctctctggattcccattgctgctctttaagatagacattgcataattatatctgccgttttccaggtgcataatcccggaaatacggggtgtatagttagggccatccggctcaaattctcttgagcgcagactctgctcaaatgtcatctgcctgtccatgccttcatatatggtgtccgtctgatccccgtttgttacgatcgttttattgcccagtacacgaaccggtgcataaataataaggcttgggtctgtcagtttggaagggtcgaacgcctgtgtcctgattccttccccatcttccacaaagatgcggttgcggctgttctcgcttctacccataatgaaataagcagtcacggcttttttgccgtcttcactcttcccaatgataatacctctcccgggatacgagttattctttaattcctgctcgattgataacattttcataagatggctctcctttgaatttcatgattatttcgctgtatacagacttattatacccgcgaactcgcgtaagttcaataactaagctgagttttttctcatgcgcactttgctgatccggttccccttcatctcctcaatagaaaattccacctggtctgccgcaattgtctcccggctctccttacccggaatataccccagttgttcaatcagatatcctgacagggtgtcataattctctgtaaccagcttcagtcccatctcttcgttcaggtcatctatgagaatcccgccatccaacatatattcattttcattcagcggaataatctcctggacaacttcctcatattcctcgctgatttctcccataatctcttcaaccaggtcttccaccgtaacaattcctgaaaaaccgccgtattcatctaccaatacagccatgtgctttctggacttctgaaggtcgcggaacagttcatccgcatcctttgtatcgggcacgaaatagggcttacgaaccactttcctgatatccaggccgtcccagccattcttacacacttcgatcatcacgtccttgatatgaagaattccgatgatattatctatattcccctcatacacagggattctggagtgtctggattccagaatttcatctgccagagtcgcaaagggctcctccacatccagcacatacacgtcccgtctcggcaccataacttcccgggccgtcctgtcgtcaaatgaaaatacagaattgatcatctcccgctcttcatcctcaaaagtaccattttcatttcccatcttcaatagggctttgatctcttcttctgtcacagcctcttcctgatcctccgttttcagcctgagcagccgcaggacagctttcgtcgatacagacaatagcttaataaatggtgaaagtatcttagaaatatagtggatgggcataaccgtcaccatacagaacgcctccgccttctgcagtgcaatccttttgggcacaagctcaccaaacacaaggttaaagaacatcaaaagcagagtcacgccatttctggcaatcgccatactgtacggtacattcatgttctcaagccatgctgcaagcgtaggcgcaatccccgccgccgcagatgcactggaataaaatccggcaaatgttatcgctacctgaatcgttgaaagaaacttcgtagaatcctcaaagaggctttggatcacgactgcctttttattcccctcctccgcaaggctcctgatcctgttcttattcacagagaccacggccatctcggcaccggcaaaaaaagcattcatgagcgtgaaaaataataagagtaacagttgaaataaaatcgtgttcccgtcagggtctgagtccatagtaaaaaataatcctcctaataataattttttacgcctgtggcgtttacattccggaaagaggctcccctctttacagaatgtttttagatggagtatagcatgaagcaggctatttggcaataccgaaatctttataaaaacttactttcgcttgtagatgggcggggaacgctttatgacagggaggacggggaggtgctgggactcccgagcctaaaactcattcaccaactcccaataccaacgttcagtttcgcttttttcctggctatttatcagtaccgtatattgtggaagttctatttttaaaatcggagaatagccgcggtaaatatacatccggaactctccctgctttttctccctaaatttaccgacaagctggcgttcgtctccgaggccgttcgtccttgtaaaatccccatcaggcattgaatccagcagttctatcccttttatctcatcccgtttaaacgaaataggagccataggggatgagacactgatatcatcgccgttaaccaccaggtatctgggggtaaaatccatcttcagaaataccatcagtattatgataaaggtaataagaacaaaacttatagtcccaaaagtaaggacctttcctcctgtccggcccatattcgtagtgtaattggaagtacaataccgatccggcacccatactcttggatcattcggattataataccatccacttttccagtatatatcgtcatccacatatagtggatgctggtcttcctttatgatatctttctttttccatctgaggtatagaaatgcagccaggatcaggattcccatgatacactgaaccactatgtaccataggatgtttgccggcgtaaaggcccgcagccgtactcccgagtaaatcacggtcccgatagccagcagattcaaataattactgatcatccagatacctgaccagactctcttgacaagccggttcactttcaagttgatctttgtgctgctgctgtaaacctcatttcttctgcgcactgaccacaaatgcatcccggtaaagaacaacgctgatacaatggcggctcctgtaaccccccacatttccggcgcctttgcaagagtttcccggacaggctggataaaaaccaaaacccctgctgccgcaaaaacaggaagattccaccaaatagagaagggaagtctgtcattctctgcagaaacattcgtatctaccacaacaatcttactgccagatgctccctgccatccccgttccatcttaagatcataaagctgcctgtgggccgcattaagcagtcccatggcgcctgctgttagttcaatcagccagacgctccatacaaggataaaaatggagagataccaaaaattcaggaaacaaaccgctgccgacaacagcaggttcactgcataaaaccattttgtcctgcgcctgtgtttctccatcagtgcttctacttcctgttcatgcagggcataggatggtatatgaacccccagcagcattccttcactgtaggttctccggtgtccataaaccgccatgaatattactgttataaatatatccgtaaataaaaaaattagaaaaacagccatgcagcctccttctcagactttctatccctctgttgccgtttcatattcctgcaaatgcagctccgaaaacatcttttcgcagagggataagaactcctgctgattcatccctttcaattttgcctccgccgtcagtagctccaattcctcttccagcttctcatggaatacgccgtccgcaccctgtaccggccgcaccacagctccatgccgtctgtcaatctcaataaacccttctgcttttagtacctgatacgctttattcaccgtcatcgtatttattcccgcgtctcctgcaagctgccgcacagttggaagcctctccccaacccttagttcccctcttccaatgcccagcacaatctgattgcgcagctgcacatatataggaatatctccggacatatccagttttagaatcacaatatcacctcctcgaaaattatttttatgttacacgcttctacttgtattatttattataatacaaataatacataagtcaaccatgtttatcttaaacacttatatatttggtccaaatggcttttattgcccccctgcgagatatacggacgggatggcggcaaaaaaccgggataggttctatatatactgaacctatcccggctatcccggcggcatccccctctttttcagacagacgcccttctaattcattcactcatcttccagtgcacaattctttgcctcttgtatatagtgttccaccttattctgcggtatccccagcgcataccccagttcgctgtacagcgcatgctcaatcaactgctggtatttcttatcaatactggttatgctgcctctgctcagcgttcttttatggagtgtcttcagtacttttacccaatcttttggtctattgccggagatacagtctttgtattcacgctccctcagcttttcattctggatccagagcacatcaatctcatccaatttatggatcagttcgatcgcctcgtctctgctcaccggtttcctgatattttccctatcttctgtcggcacatatgcccgctctcttgaatcctccaaagactgcagggtataatacttttttctgcggtccacaaagctaaaattcaaagttcctacatcttctaccttaaacatccctttgcacttataaactactacttcacccggattcattctttacgcttcctctttctttccaaatctactgcaggtacactctgactataataattagtatttaagaaaggccggtacatcatctgtaacggcctgttctcagcttctatattttgattatagcatattttccggctttttgtaaggcttttcactcctatccgataaatttcatgaatttgtttcaaaaatcccctacagatctttgtgtattctgcacagtcagggccatgaatcgccagatatatggctccttaccgaccttctcctgcctgtatctgtttccggtattctttcggggtcatctgcaccgattctttaaatatcctgaaaaaatggctggggcttgaatacccacaggcctcggatacctgatagacggtaagcccggtatcggccagaaggtgcatggcctcattcagcctggcctccttcatgatatcacggcaatttctaccagtgtgcttctttatatatccagtgagatagttggcattgtatcccaggcccgctgccatttcctccagggtctgctgcatacagtgttcccgtacatactgaagcactttccccgcctttctgtccatgccatagtaactgtaccggccacgcttcacaagactgtcaagaagcaaaagaagccaagcttcgagtgcaaaagtctgatggaatcccgcctgcgtgtactcttcgaccatattgttcatgaatatcggaatatttttgctgtatccggtagaaaagaacatgtatttttctttgcccggattatcatatctcaaaaattccgagattggatttttatccatcacaaactcccgcaatgtccgcccaaagagtttatccttaatacagacatttacgataagcgtctccggatttacacaatggattgcctgaagcgcatatttgttcaacaatacaatatctccctgggacatgtaaagctctacgccatcgatctcattcaacagctccccctggcatacatagcacaattcaaaaaaatcatgattatgcagcggaaaatcctctgtcacctcatgtcccaatatgtaaatattctcccgttcgggaaatccggatgcaagtttttgaatatcgtggataaaataatgttcctccagctcgttatagttgtgcttaagcagctcctgtggaaggataactttatgctctctctgcggttctccccggcggttttttacaacagccagggactccgccattttattctgccgcatatgtgcctcctccgtgaactttatactgcgcctgtgtcttttttccgccccaattgaaatatgagaaaatcacacattaacgtgtaattactccctgttctgatcactcattttaccatataatattggtataagcaatgaaactaaggaggtggcgggtgtgaaaacatatgtgattcatttagatactgtgcaaaatttaaaagactatctgtatatgctgggaagtttttcttttacaggaattgttgcaacagactgtgccaatgtccagccagaagacattctctctctgttcgaccgctgcagcgacggcacatttgtactgatggttcagggctgtgaagagcaggtgctggaaagcatggagaaatatttagaagattgcggtcttgtctgccataataaaaaaactgcatgaactgaatgaccgatcaactagggatttttttaactgcaaaaggaatagatcataagtcattaaatccctaaaatatatagttacattataacatctcctctcaaaaaaccaatacttttaatcattaaaaaactccccaagacggaagtcctgaggagttgtaaaatctttttgaaattgtacgtgttgaaacgtatgcttatctcttactgaactgtggtgctctacgagctgctttgagaccgtacttcttacgttctttcatacgtggatcacgtgtcaggtaaccagctgacttcagaatcggtctgtagtccggatctgcttcaagaagtgctcttgaaataccatgacggattgctcctgcctgtcctgtatatccgcctccatgtacattaaccagtacatcaaatttgtcgcttgttgatgttgctacaagcggctggcgaacaacgaccttcaatgtctccagtcctaaataatcgtcaatgtctcttttatttatagtgatcttacctgttccaggtacaagatatactcttgcgatagatttttttcttcttcctgttccgtaatattttgcgttagccactgtaatgtcctcctttcaacctttccttaaaatgttaatacttctggtttctgagcctgctgtttgtgctctgggccagcgtatacatgaagtttgttcatcatcgttctacctaaaggtccttttggaagcattccttttacagccagttcaatgacctgctccggcttcttgtccatcatctctgccagtgtagtctctctcatgccgcctacgtattcagagtggttataatatatcttctgctgtaacttcttacctgttacctttaccttctctgcatttacaactacaacgtagtcgcctgtatcaacatgtggtgtgaattctggtttgttcttacctcttaaaacttttgcaatctcagatgcaaggcgtcctaaagtacatccttcagcgtcaaccacataccattttctttcaatcttgtctgggttagccatataagtcttcatgggtgttcctcctatcataatcatatcatataacttaacttgcttaattttttatatgaaatcagcgcactccggggctttggtgtatgctgtttctccttttttcatgctgttctattatagtatgttagcatcccgttgtcaacatttttttctttttccacgataaaatccacgataaaattgtaataaaaaaagtaataaagccatgaaatttcagcccccctaaaggctccccgtaatgcaagccctgcatctcttgcagggcttgcattacgggacgccctttggatagatcttcttttaattttaagtactattaaaatgcattatttttacccggatttatgatatactaaaaaagtatacttattatacaaacataaaaaaattttagaaagcaggtggaatttatgtgggcttataatgaaactttctatcaaatatatccgattggattttgtgacgcccccgtccataatgacggtatcacagtaccccgtatacgtaagattgcaaagtggggaggatatctccaggagcttggaataggatccattattctgaatccgatttttgaatccgataatcacggatatgatacccgggattttaaaaaagtagactgccgcctcggcacgaatgaagattttaaatacgtatgtgaaacgctgcactcccatgatgtcaaaatcatgctggatggggtcttcaaccatgtaggccgcggtttttgggcatttcaggatgtacaggaaaagaaatgggaatctccgtacaaggactggtttctcattaattttgacggcaacagcggttataacgatggcttttggtatgagggctgggaaggccatttcgagctggttaagctgaatctgcaaaatcctgcagtcacagattacctgctggattgtgtccgattctggattgaagaattcggcattgacggactgcgcctcgatgttgcttacagcctggaccacaactttatgagacgtctccgcgcattctgcgaagagctcaaaccaggatttgccctgattggagaagtgctctttggcgactataacctgatcgtcaatgacgaaatgctgcacagctgtaccaattatgaatgctacaagggcatctattccagctttaacagcatgaatctctttgaaatcgcccattcactcaaccgccagtacggcccggaacagtggtgcatatacaggggcaagcatctgatgaacttcgtagataatcacgatgtcacccgaattgccagtattttaacgaataaagaacatatcatccctgcttatggcatcctattcggcatgccaggcatcccttgcctctattatggaagcgaatggggagaagaggggataaaggccccggacaacgattacgctttgcgcccttcatttgacgaaccaaagccgaacaacctgacagcctacatccgtaccctaatcacactccgcagagaaagcgatgccctatgtaacggcggataccataacgtagtcatcacaaaccaccagctgatctttgagcggaaatcaaaaaaagaaaaaatcctggtagcaatcaacgcctccgcttccgacttcaccgcagaaaacggagaactgcggggagattatacagatctcataacaggcagagaaggcacattaaacggccgacttgatatgaagccttatagtgtacagtatttgagggttgggtagaaggggctccctcttcggtccactgcccccgcctttatgcacctcccccggaggtgcataatgtcccggccggatgcgccagctttaaggaatcggggaaagacttttttgaatgcgtcttttgcggtgttacaaccgctgcatcaaaataaaagccaacatatgaattgacggcagggccaccagccctgccgtcaaaccgacttatacaggaatgcatcggcattcccatttccccacacatcatacttccttcacaagcacctttaggatttccgccatgtacatggtgtgatagtctttccccggatagcatcttgaatcattttctttctcatcaaaatgttctgatgacatatcctgatgatattgttttttgcagacgagtatcatatttgcttcttcgaatgcggttgtcccgtccgtatagtagggggtcagccctgcctctgcttctttgtcgcagtcttttccggacttgctgccgcagatgttcaatgcttttctgtatgattcgtcgtagaaggacagcgtaaacaactcattggcatccacaaattcttttgtgtaacgctgcgggcggatgtagacgctcactacgttttttccccacataatccccataccgccccagctggcagtcatggtgttgtgtttctcttcatccccggcggttacgagcatccactctttcccaatctttgtaaatggattaaactgcagttcttctgcagatacttctctaaatcccatcatcgattaccccctgtatttgtattatattatttttactcaggttctgcttattttaataccactttacggaagttctttttcccctttttcagtattacgccttctcctgacaatacatctgctgtaaatgacgcatggatgtctgtgattttttctccgtccacagcgaccccgccctgttctaccgcgcgtctcgcctctgatttggaggaaacaaggccgctctttaaaagcagggtgagaatatcggcagtattctctgtcagatcctctgcagtcagttctgccgtcggcatttccgccgcatttccctggctgaagagggctcttgcactttcctgtgccttgtctgcctcctctttgccgtgtatcatctgtgtcagttcgtatgccagtatttctttcgctttgtttaactgactgccttcccatgaatccattgcgtcaatttgttccagaggcaggaacgtaagcatacggatgcacttcaatacatcggcgtccgcaatgtttctccagtattggtagaactcgaacggagatgttttgtttggatcaagccacacagcgcccgactgggttttccccattttctttccctctgagttcagaagcagagtaatggtcatggcgcttgcatcttttccaagttttctgcggatgagttctgttcccgcaagcatatttccccactggtcatccccgccaaactgcaggttacagccatatttctggtataaagcataaaaatcatatgcctgcataatcatatagttgaattccaggaaggtcaggcccttctccattctctgcttatagcactccgcagcaagcatccggtttacgctgaaatgagacccgacttcccgcagaacttcgatataattcaagtccagaagccagtcggcattatttaccatcattgcttttccttcagaaaaatcgatgaaattactcatctgttttttgaagcagtcacaattgtgctgaataatttccggcgtcatcatctggcgcatatcggatcttccggatgggtcaccgatcatccctgtgcctcccccgatcaaagcaatgggcttattccccgccatctgcaggcgtttcatcaggcagagcgccatgaaatgccctacatggaggctgtctgccgtgggatcgaatccgatataaaatgtagccttcccattattgattaattcagaaatcaatttttcgtctgttacctgggcaatcagccctctggcctgtaattcttcatacagtgtcattttttcattcatcctttcttttgtggttctgataataagcgtgcaggcgaagaattatatgcattcttgtgcactccgcatttcacgcaaaaagagccctccatccaaaaggacgagggctcataaaactcgtggtaccacctttattcgcagacgattcgcatcccctgcctcagtgagtatatcctgcacacatagcgaccgcttgatccgtcctgcataccgtgcataattactcagtgcaataacgtgcaccaccccgtcacagcctacttgcatacccgcctgctgtacagcggataactccaatgcttttggtgtgaagctccgagatgtattcataaccaatcgtgtcgcgcgcctctcatcagccggcagctttctgttttctccgaatcagctattacttgttctcttcatcgcttttttcatatctgttgcaatcttatcttattcttctgaatttgtcaaggcggaaatttgagttttggaggacgcgaaataaagggagcgcggacatcatgccaaatacgcatatgacgtttcgataggcgaatacgcttaaagcatttcaataaatgccgccagccttgtattgagctgtcccaggtcagccatagaataatccgtttctacactgatatagggcttcccctttccatttacaaatttgcgtatccccatggattccacgctgtatgtatgacaggcctgcaggatcacttctaccacgccgtctactttaaactcttccataagtcgtcccaaaagttccagacggtttggattcggagtcataactgaacacccgatatccagatatcttctggcaagcgtctcatagatatcctcggcttccttcccacgttcctgccttctccatattcccttatgatcttttctgtcagcgcatccacttctcccgggattgcttttttatcaaacttaaaggtactgccatacataacatgaaacagatcctgcccgctgatgggcgccggatcatttgccatcacactgtacagcccctttatggatcttctgacctcattcataacccgcacagcttctcttagcttttcatccgttattttaacttcaaatttttcctccagatattccttcacgcggataatttcgttcttccacagcctgagcccgtcttctgactggcggtttggaagttccatcagatagaccggtttaatttccgacatatactcatgcatctttttcttaccgtcacaggtagtctctcccacaaccacatcagaaaaatagaaaaacggacatttatcggtctttgcaaatccataactagacttgatcagcggacacagatttttcggcaaatctttttccgcctcggaaatggtctcgtcagatgtggaacaaagccctacaactgccgcccccatagccatggcgatctcctggggaaaataggtacagtaacccccaactacaggtatccccttttccttcagctctagagctgatcggcagcgccgtcccctgtgcagccagctcaaacagttcatccagcgctatccccagccggttagccataatctccagaaacttgcccgttcctgccgagcatttatcattcataagaaaatctgtcacggctccattttgaatccggatcacttttgtatcctgtccgcccacatcaatcccatcttcttccaggcgagcctgaatcacccctgccgtctcccgtccgctccatcctgtgggcatcacaaactgctgcgccttctccccccgcaccaccaccttagacgcgctggacccaatatcaattccaacataattcatcctaaaaactcctgtctttatactctcctactaatgctaacatgtactcccataaaagtcatatcgcttttttgtatgtatggggggatttattgatggggtcgatgaagggaggacacctgattggggaggggattgtgcgacggcgggggagcctgcatatcggaaatagttgatccacccatttgtgtatttccttagtttctcttccctttccgagttgccccacttgttccctctggttgtaagttcccttaggcggtttttcatcttatccacggatttcgggtgtactctcagccagcatttccctttatttcactattcaaccgtgtccactttcctcaggttaatctcccttataatctcaggctcaatcttatagtttcgttcaatatccatcagaccattgatttcctgttggatatccgtcacttgagtatagcagtatccacaggaatacggaagttttttcatagcagtcgtgatatcatcaaaccgcttgataaattcttctttcgagttcactttattgccatacccccagccctgttcaccattgtcgaaagcaatacccccaaattcactgattatgatgggttgccccttatatatataaccgtttgcaaaggcagattttcgattgcaatgatatatcctagtgtccataagttcatctttgtgagctagatatctgtgaagaaaatcctctcccttttcttcataatcatgaagcgtaataatatctgatacggtatgttcccatccatcattgacaatgactgggcgccccttgtcaaggctttttgtaaggtgatagatcatctctgtaaaatgttgctgcatcggttctgtctctactgacgggactccccaggattcattcaccggtgtccacgtgatgatagatgggtgattataattctgccttacaatatcactccactctttcatgaacaataccacggaatcatccgtataggtataattagacggtgcttcaccccagactaacattcccatcacatcacaccagtaaagaaatctctcatcctcagtcttttgatgctttcggataccattgtatccaagattctgcaccttcttaatatctgtcacaagtgcttcttcatccggaggtgtaaggtgactttccttccaatatccctgatccaaaatcaaccgttggtaaagtggttctccattcaggaggatgttcgggccatcgatgcgaatttctctcattccaaaatatgatcccacttcatccaaaagttcagtcccttcgtatacccggaactcgatatcatataaatttggttcctccggtgaccatttataaaatccccactccgtgtctgcattatggattcctcgtaaatccaattgcatccttacaatgtcttcatccaccattgcccggcatcttgcgacaagagtatccttgaaaaaagcggccgcttccacgtccagatttcttcctttggctccctccaacatacattctatctccagagttcccttttcgagatccggtgtcatctttacatgttccaatctgctttccggcaccatttccatccatacagatttccagataccggttgtttggacataccaacatccgaaattctttggcagccatctttgttttcccctgggctgacgcggatccaaactgtcctccactctgactgtcactatgttctcaccgtctgccaatacagaggtcatatcaaagctgaaccgtgtatatccacccttgtgctgccccagacattctccattgacccagacctttgtagtgaaatcacttccctcaaaatggagtattgcccgctgatttttcatagcctttttatcaatttcaaaagtccttctataccacacataattatgtaccgactcatcaccgataccacttttctctgtctcatatgtgaacggaacctggatttttctctgagcatcaaacgtctgataccacttttctatctcaccgcggttctcgtcgtcaaagcgaaacccccactccccactaaggtccacccagttatcccgtacaaattgtggccttgggtagttttttttataacatttcatctctcttctagtctccttctagttatctgtcaaaccacacttccagcgtttcttctttatgaatggtaaccggttcttccaataggatttcaacaccttttactcccttttctacagagaattgcaagttttcccccccacaagagatgccgcatatatcttcatattgttctggaagcccgaatctctggatggtgacaagtccatactccacttctagctttgttccctctgctgacagttcaaagagtccccagccagaatccatactgaagaaagaagcaaacctttcctgttctaatttcggatagaaagctatcctttgctgccccatatctacctcatacccactcaccgcaggtaccaacgaaaaacttgccatgcttctcgcataattgcttccacattcaaattcattccacgggttgcgctgctctccatcgaaccggtcacggatatccttcacgatctcaaacccttcttcaaggagtccttcctgaatcatatgggccgctgcctgatattccagaccacagaacacttcatctgcataagtaagtggtacggaaggcttcggtgctccgtccggccacccacatatcttcaaatagcggtcgtcatccaacgcatagatccgtcctgcattaaatgtattccttgcatctaggacacggttgtacttatagatggagcgcagcgcgcttttcgtcttttcttcctcaaagatttcacccagaccgcacagattcgcatgccactgtgccagtacctgatccgttgcacacccgtttgccacctgatatttaatttcctctgtttctttattccagtatgcatcgattgctgtatagccatcgattgagagcatcttgtcgtattttttcagcaaagtcatatcctttaaatccacatcctgctggaaatactctccattaaaaagaatcttgttgcaaaacttctttccattttcaaaaagacgcagatacaatactttttcctcttcgtatcctaatacttcggcaatatttgctccggctttcagcgcgccaagataaaatccgttcagccagctgcttggaccaaaaagctccatgtccatagtatgatgctgccgtccctcgaggataccatcctgattctcgtcccatcggtccagattcgtctccgcccatgcaaactctatactctttttaatcggaatccaattcttagaaagccactctttgtcaccacatagaagatagtctctccacgccttcatcacaccgcccatctggccatccacacacggtctgaatccatcccgctcccggccaagaggcagcatcaaacgaaacgacattccaccgtcctctctctgattataggcaaagtctacatccctcatacttctctccaacttcgggaagagatacggcagtgcatacgcataattccatacatgagtgcagcttccctcacagattccttctgttagtccgcttccctcaaacccgtagaattcaccattttccaatctaaggcaggttgcggtcttcaaaatagacatatttgcagagactgcctccaaacaaaaatccggaagtgatgtctgatacagtgtatctttgaaaagctttgtgtcacggtacaacctgtcccagttgctgatcccataaaccgcacaatcctttgcgcttcccgtaagcttagtgtagtaattctgccagatgactggtgcctctgctttaggctctggatgccatgtattggcacaattcggaaaataccaggtcagaatgaagcggattttctttttctcccctgcctccagctcgcagtgagccgccagtgtggcatgctcttctccgtccagcacgtatggtgtcctgtcgttcccacggattgatggatagaatcgattcttaagatgcccgcctttcatcacgtcatgccagtacatttccagactgtcaaaccattctgcccgataccaatattcctgatagctgatatcctcgtgatccgttgcaatacataggttgccccacaccaaatcttttgtgtctaccttttcacactctaactggattccgctcatacttccctcttttacaaaactgttcttccccgtcccgtaaggaagagggttattcaaagtaaaaaaggctgtatagtccagcctatcagaagttggattttcgaattccacctcaaaatgtgctgccggcagggaagaatctttgtcattcagaggaataaatgtactgaatgctgacagcttcactcctcccgggaaagaagcgtcccgaaattccatctcagcgaacggatattctcctttgaattcccattccttaaaatgcggaactcctgccatcgtccctctatatggtcccatgccgtatccgaatccgccattcccacgggctacgtttcttgtctctcctcctgtagcaccgtcaatccagtctccctgcagaacacgagcatccaatacttcccctttcttttctgccctgaccatgatatgtgtgaatccattagatgtgtttttatagggatgattgtaaatctcccaatccttcaggcgcccgttgcctgccagcccgatacatccggcaccaatccctcccaatgggaatgagatttccttcgttttatgatttctataacttttcatgtgaacctccagctatgtaatgttatcctttcactcctgaagagagtgataaagattgtaggaaatatttttgtgcaaaaatatataataaaaatgtcggaataatagacaccaccgctgcagtcaggatagatgccagataaaagttaccatatgcccccatcaaaagctgcagtcctggggtcagcggcatcttctgtacatcgttgaaaacgattgatggccaaagaagatcattccactggctcgtaaatgtaaacagaaccaccacagtgacaaccggcttcatcataggcataataactcgggaatagatagtaaattctcctgcgccgtcaatccgcgccgcctcatcaaagttctttggtatccccagcataaattgccgcatcaggaacatattcgtcactcctgccaatgaaggcacgatcacagcagccatcttgttcacccagccgaacatatttacaatctggtaaagagggattatattcacaatctgggggaagaatgacagtgcaagcatacagtagaacaccttgtcccttcctttccattcaatcctcgtatatccataagctgcaagagaaagcagaatcacagatcctgcagcgcttactgtcgaaatcaccaatgagtttaccagccatttcagcaccggagtattccctgtactagtcagtacatatttgtaattctcgagtgtccatgtctggggaataaaatgaaagtttaaatctttgatttctatttcacttttcaggcttgataaaatgccataacagattggcagcacccatatcaggcagatcagccccaccagcagcccgattataaaccggcgaagagacgtcttctttttcatcgtctttccctcctaatcttcattccgtatcagcttaaactggaatatggaaataattgcaataaaaatacccagaataaccgccattgcggatgctattcctgcagcagactgtcctgaaccaaacgcgatgttccgtatatggtataccagtaccttaaccgccggtgccgtagccgggtctaccctcgtcatgatcgttggctgcccataaacattaaaacttccggcaacagtgattaccagggtatacagtaattggaagcgtattgaaggaagtgtgatcttgaaaaactttacgattcctccggcgccatcaatttccgctgcctcataaagatcctgcgataccccgctcagtgccgcctgataaataaccatgttcgcccccatcgtccaccagaccgtcataaccatcaaagcgatccaggcatagggcatggtcgttgcccaaggaacctttgcccccatcatggatgcaagcccaaaacggcgattcaaaagctgcatccagattaatcccaccgatgtgacagaaaataatgttggcagatataatacagactggaaaaacttcgatccatatggacgcagatgcaatacaagtgcaaacccaagtggtacaacaatacacaaaggaacattcaaaactacaaatagcagcgtattccttatgccttccataaactgccgattaaaggtagacttactattcagtaaaatttctttataatttgccagccctacccactccggtgtgccaatcatgtcccaatttgtgaacgaaatgtatatcccgaacacgataggaatacagacgaaaatgataaaaagtatcatatgtggtacaatgaacgcatactgcaggaagctgcgctttttctttctgttttcctttatgcccacttcgtatttcccactcatagaaattcctcgctctatcacttattacaaaacagttacctgatacctctcaaatgaaataactgcacgaccatactccgtggattgtgcagtcacttcacttgtaatgtactcgcgtgtcaccctggtataacgcaaaagtacaattctattattgctgctgggcaatattatctactgtcctttgctgcacttgttccagcatctcgccaagatccattcttccccagagcgcttccatatgtacctcggatacagcgtcgtcagcaattccgccgtatttgtagctgcggaaagtaatggtatcttcttctgccggatcagaaacatagaaatatcccggcatttctttaaactctgcctcatcatctgcacctctggatgccggaacctgaccacttcgtgcccattccatagtattttctcttacaaagtcaagaaaatctgcgatgactactttcttttcgtctgttctttcctcgctcttgaataagacgaactggtttgaatttgcaaagttaacgatcttgtctggtgagtatgcaatggtgttggtcattccataatccaaatcttctgccttccttagtgcattgtaatcccacacccctgtatgacagaaaatagacatattgttgataaagagctgcaagttatcatcaccgtcttcacttccgcctccggcttcctgaatcgcaatcaatgtctcataagcttttttcatctcaggactgttcaaatttggtgtcacgccgtcttctttaaagataaacccaccttcctgtgccgccaaggataatgccatctcataggtaaagaaggaaacaggaagtgtaatgatgccgtctttttttgcatccggaataatctccatgatttcgtctacggtaaccacattgtcatccagcacgtttggtgcatatttctctactaactctttgttatataaaagtccggtcactcccatatcaagagggatggaatattgtgttccgtctatatttcctgtattccatacagcatctcgataattttcttttttaatctccggcttgctttccagaatctcatccattggttctaaaagtccctgatctacaaacatcggcacacgtgccacatctacgatacagagatcaggcacgccttcacctgaattcacaactgtcggaatcttctggtacatatctcctccggccattgtaatattattgatcttatactccggatttgtcttattgaactcctcaaccatcttgttcatattatccccgtcaggtccggtaaaaaaattccaaaaatcaatctttttcccgtcacttatctggctctctgtttttgtcccatccttgttctccgggtctgcctttttttcaccacccgaacatgcagtcagaccgcacaacatagccattgccaccatgacagaaaccgcaccttttaaatttcttttcatacacttttcctcctttttaaatatcctcttttatttagaacagtttttttgtttctttaattgtacattaccactattttgcatatatgtcaacatatttattgtttattttatactttttgtacaatatatcccctgttattctataattaaaaacatatttattgttttaattcgttttacacctttctctcaagatccttgtttctatcatttactagtgcactgtctcattgatattcaacctaataactaggctaaatttccagattcagtatgtaaaaagcataagcgtagccccactacgcctatgcttttttacatactgaatctaaaaatttattctgcgctattaagataaatctcaatgtgccagtacactagctttcttaataatttaaaaaatgcgtccccgcaattgatacgaaaacgcactttttattaatattattagttagtattcaatcgtcataacgatatcctgtgcatagtctcctgctttcctgccaaaaaaattgaacccgcctacatattttgcatccggcttgttgccaaaccgcaccgtaatatatggcttattctcgatctccatccctgccagggcactctctcccactttcgtatcatttacatagcatgcatcaccatctatgctccagcttaccaaaagaccatattgggtattcccttccttgatccattctggtgtaagcctccctctgcgctttccaaaatcacctggactggtccatgttccacaatctatgccattcatccacaatgtaatgtctgacttccaatcctcacgataattaggcgcttcggaacaaatctctgccgataccataatccgctttatctctttgccttcgggcacaaggttggaaaaacgatattctacatatcctgctgaagaccatagaatctgtgcatctgcgcgctccggagaataaaacatttcaggcttgtcttcattcccaatcatatcccattcggtcccaattccgcatgtcggatagatttcacaatcggtaaaagcacctaccggcatactgattgtctttaccttgcttgttttatcttccagactgtgcaggcgaatggtcaccaaatcccctttcctgctgcacaccttcgcacttcctctctcaccgggctgctgctcggtattgattagtccagcctcctctaatgtttttacatgaagtcctgcactggacgcaggaagtgagagcttttctgcaatctctcttacattatagctattggtataaagtaatttgataatctcgatacgaagtggcgaagaaagtgctttcgctactgtgcatagcttctccggagcatctgcactcagttctatatattttgccatatggtcaccgcttttctttttttcattcaattcttatttctttaattataatagcatcctaaaaaattgtctagctcgttttctccctgattatcaataactagtttcccgtgtgacatctttcagccacttatagcttttgtaccgcacccaggtaatcgttactttaatcagctcttcacacatcaatatcgtatacttatctgcatttgcttcgattgtcgtaccatcaataaaaatggattcatcagaaacttctcctatttcataaagatagttactgacttccaccataatttttttcaattggagcaaaatgaatggtacgaaatcgtgcgattatagcatgatcaggcgctggtgcgtcctccaaaagaaacatgaaattgatgtccctgtgacatgctgtttcgatgtcgcgaaatgagtagagtttattcatgtaagcatatatcataatcttcagcatctgtcgtggcgttgcagtattttttcgaattcggaaataaatcctatataaatctgaaatacccatctcctttacgaattgacttagtagacgcaccgaatcattatctgggattatgcaatcaatatttagcgacaattttagttgataaaaactagttgccagagtataattcttttgtaagagattttttatttgcataaatatattttacaccttttgccaggctttccgaagcctggcaattgtgttttttgcatgaaaaaggagctgtgcactaattacttagtgcgacagccccaaaccgacccgaagtgagaattcatcagagttctcgcaagtgtcggcggtgttcagtatgccggctccgattttgattagcggcacttatgccctaattccgcatccagaacaggcatatttcaattccacgcagcgtccccccatccaaaacccaccatcatcaaaacctactgacagagtttcttaaattcgtcggctacgaattgtacttttgttcctatgatgacctgaacagcatttttgctcggcctgattacgcctgcaacgcctgctgatttgatcatcttttcgtttactgctgtataatctttgatttcaagacgaagtcttgtgatacagttgtcaacggatgtaacgttttccttgccgcctacgccttccagaatgattttcgcgatttctgtgaagttgtcattggaaagctgtacttttgcttcatctatatcatcgtcctcacgtcccggtgttttcaggttgaacttcacaataacgattctgaagacaatgtagtaaacaacagctacaataagtccgattggaatcaggtacagcgggttttctgcgaacggagctttgaagctcaggaaccagtctacgaagcccgcactgaagttgaagcccgcacgtaccggcagcagggctacaattgccatagaaatacctgttaacagggcgtggatcgcgtaaagcgccggtgcaaggaacatgaatgcgaattccagaggttcggtaacacctgtgaagaaggaagataatgccgctgccattaacagacctgccgcaactttcttcttgttttcttttgctgtgtggtacatagccagtgcagctgccggaagaccgaacatcattaccgggaagaaacctgacatatacatacctgtctggcctaagataccgccctccattgtgccccagaacttaccgatatcattgatgccggcaacatcaaaccaaaatacggagttcagtgcgtggtgcaggccgaacggaatcagcagtctgttgaagaagccgtaaatacctgctccgattgctcctgtgctcatgatagcctcaccaaatgctacgagtgctccataaattaccggccatacaaagtacagtatgatagttgctacgagagaagcgcctgccgttacaatcgcaacgcatctcttgccgctgaagaatgacagcgcatcgggtaatttagttgacttaaatttgttgtagcaagccgctccgatcaaaccacagagaataccgataaactgtgtctgtgtctttccaaatgcggcaggaacaactgcctcttccacacctttgaacattgcaacaacggatgtggataacagcgttgtaatcatcagccatgaaacaagtcctgcaaggcctgccgtaccatcattgtcatcagacataccaacagcaacaccgattgcaaacagaatcgccatattgtcgatcaaagctcccccagctttcagcaagaatgctgcgacaatgttgttggccccccagcctgacgggtcaatccaataaccaattcccatcagaatagccgctaccggaagacatgcaaccggaagcatcaaggatttacctagtctttgtaaatacttcatgtttttcctccttcttgaatccctttgattgatataatcccatttattttaaaccggcgcgctgccggataaaatacgccccgctatgcggcttatttttctactacagaaagaacgtcgtcccctgctgctacctgtttatcagccattgcctccacagatgcatagtctccggtgttacagatcagcatcggagttatgatatcgtatccggctgctttaactttctccagatccaccgtcagaagaaggtcgccttttttcactttgtcaccggctttcacatggccctcaaagccttctcccttcattttcaccgtgtcgaggcctacatggatcagaacctctgcaccgtactctgttgtcaagctgacagcatgaagtgtgtcgaataccattccgatttcaccatcggccggtgcatagattttgccctctgaaggaatcactgcaacgcctttacctagaatctcctcggcgaatgtaggatcatttacctctttaatcgaaacagccctgcccgctgcaggtgctcccaacatatgctttaaatcttttttctttaaaaaatgaaacatctttcttcctccttttattcttctgccatcgtgactctccggatatggatggccagatacataatttcttctccggatatcttactgtttgttgcatcttctatataatctgcaacttttctgctgcacgcatattctcttggatatttggtcatcatcatctccgccagctcgctttcctcattgggaagcagttcttttcgatatactctctgtaaaaggaacttcacatgagtgacaaatctttcatagtggagcgaatcttcatcaaactccatattcagttcactcttgacaatatcgagtatatctttcatcagatttggaaagttcagggcgtccctgatgtccgttccgtactctgcatttacaaaatgaagcgctatgaaaccggcctcgtcatccggcagtgcaatatgaagtctctcccagatcatatccaccgcatatttccccagctggtactcctgctgataaaatcttttaatctcccagagaagcgcattttcaggtttgatcccctgcgtaaaccgctcaatcgcaaaattgatatggtctgtcagtgtaacgtatatgctttggttcagctttaatttgaggtgcttcttcgcatgagagataatgtcgttagatatctgcgcatgctccagaggcatatttgcaagcagctccttgaactgatccgctaaactctggctcttgatgcgaaagattttttcaatcttctgctccgccacctcccgcccgggctttgtgccaaagcctatgccgcgtcccataatgacaacttcttttcccgtatcatcataggcggaaactatgttattatttataaccttttcaattaccataatagccctgcattcctttttaacaaattttctgcttacctgtttattgttgccagttttttcagattactattaggttctcataagacatttctggaagaaatcccttagaaactagtctgcattgtaactgttcggaacagatacggcggattttacaaaacaaaaaaaaccaaaccctataaacatgaccttttgatccgtttataaaatctggttttgcctgccaaacagtaacaatccattactattcatttgatgtttaaactataacaaaattattcacagttgtcaaccgtttgcagtgaagtaatttataatttggttataatgtttatatttttttaatattttcgtgcaaatctaccaaatcaatcatatatgaagtattccacaaatttcatatgattcatggcttcctgctgcgtcagatacttttggtctcccagatcggagccttttgccccgctggcatccacatagattgtctgaccgttcatatctactgcacagaatacataactctgctggatactccggcttttattccacatcccaagcacaacgtgtgattccattcctgccctgccgcataattcggacaagatctttgcgtaccccagcgaagtcgctttattcctggtaactgccgagaggctgttataaatgtaaacaccgtcaaacacttcctccatcgaagagacagaggatgcttcctcctctatgccggacgcaaaggacatattctcatccagccaggacaaaaaataatccaccgtctttttctccccatagtctgccggaagttctttcataatgctgtccagaatttcctctgtttcattctgcgtctgtacgatctccgagaccttttcctccgagttcaccgacaggccttcctgaaccgccgccagattctgtacctttccgtcttccccgtattcacctgcccggttaatcccctctgcacaggataagaacagaatggccttacgaatcaccttatccttcactgtcgtcaggtcggattctttatatttcacatagatgtcttcttccgtcataggaatgtcatagaagccgtaaaaataattgtacccttcatcttccagcgccgtcgttacccgcaggtattccggcccgctcatggcctccggaaatgtcaccactccgccctccatgcggtcgagcttttctctcatcagatcatataccgccgcttcttttgccgtcagctggtcataatagaacgtagataccacttctccgctattacgcggctcatccttcagctttgtcgccgtggcattagaaagtgtaatctgccgctgccagtaagccagaatcacgagaaatataatcgctaaccctgcaataaagaccgccttctgatgctttcggataaaattcatgcttgttttctcccatttacataaacagcttttacattcagatcctggtctaaaagaactaaatccgccgcttttcctggtgtaatactgccgcatgtattatagatgccgatttcctttgccgggttcatggttgcacatgcaaccgcatcctccaacggaatctccatctgctgcactgccactttcaggcagcccatcagatccgtagccgaacctgctattgtgccgtccgctagggttgctttcggtccttttacatatacgtcctgaccgcccagggtgtactctccatccgtaagccctgttgcccgcatactgtcactgattagaatgacccgctccgcgccgaacatggcaaatgtggcacgcactacagaaggatggatatgaaccccgtcacagatcagttccacatgacagtccccgtcatccctggccgcaccaataactcccggatcacggtggttgagaggcggcatcgcattgtagagatgtgtaacatggcttgcgcccttttccaaagcctcggccgcagtatcataatccgctgtggtatgcgcaatcgatacgaccacttcatcctttaccttctctataaactccattgccccgtcattttccggcgcaatgtctaccagcttaatcagtccgccggactctttctgaagctgatcaaacaatgccttatcacagttacggatatgctctgctgcctgggccccttttttcttctcgctgataaacggcccttccatgttgatgcccaccagcttcgcaccgcttccgccttcgtaggaggccgctgtcttcatgatcttatgaagctcttcctcggccagggtcattgtcgcaggacagattgaagtgacaccgatggacgcctcatattcagccatatgccttattgcatccacgctggcatcgcagaagtcgtctcccacacagccgtgaaaatgaatatccacgagtcccgggattgcaaaacagccctctccgtcgatcacttcacttcctccttctccaggagcagcgaacctatcaccgtttattacgacctcgcccggagtgaatgtctgatcttctccgaaaacatgaacatttttaataatcatatttaccttctttcttccccgcctgcaatgcccggccgctgtacttccagatactgcgtctgcagcgccggcctgctgccggcattgtaagctatcttgggatcttagataatgctgctgcgtctgcaacaaccgtaacatcgggatgcatctgcagaatggatgccggaactgcaggtgttacatcgccgtagaatgcctttgccacaatctctgccttatcctctccgcttgctactaccagaatctttctggcgcgcataatggtcccgatacccatagtatacgcctgtctcggcacatcatccacagatgcgaagaaacgtttatttgcttcgattgtgctttctgtcagatccacacagtgggtctctttgtcaaacacttccgccggttcattgaacccgatgtgcccgttgtgcccaaggccgagaagctgtaaatccaccccgcccaatgattcaatcagttcttcatatcttctgcattctttgccggagtctggttccatgccgttcggtacattggtgcgcgccggatcaatattgatacggtcaaacagatgtttatgcatgaaatagtaatagctctggtcattttctctgtcaagtcctttatattcatccaggttcgccgtggatactcctgaaaaatccaggtctcctgcctcgtacatctccaccagacggtcatatgcgccgatcggtgtagatcctgttgccagccccagtacgcattctggcttcagaacaacctgtgcggcaatgataccggctgcctttctgctcatatcggcataatcttttgcttcgataattctcatagtttttttcctccactatcacttatttgattccggttctattatataccgctgcctgcttcctgcacaagcaggaactcaaaaattagagtttcgcttgcaaaacccgcacctgctgcggccgcacagcggtttctgctccttacgctgcagtgcacatcccgccgggagggctttttatcgaatagaaaagtgctgaacaccttcctacttcgataaaaaaaccagattttcagagtataaaggtagcccttatcctccgaaaatctggttttgccttctttaagtaacaacccagtcttttagattacccttatactaacaaactgctgaccgattgtcaagcatgatcatcatgaacattttgacagtataacggtatcgcttttataaaccttgaccagaatatacagccgccgtaaggcaaagactcagcagcccagcagggcttaactgcattcctgccgccgcatttgaaagtgataaaaagcgcccagcatccccgcgtcattgcgctgttttgcgaattccaacctggttttttcaaagataactggttttaaaaacctccggagctgattcgtaaccaatggtttcagatacgcttcctgggccgcaatgccgccgcccagaaccacgacctcaggattcattacataacagatattggctatcccttccccgagaatctcggccatatgttcaattgaggctatacagaccgcatccccgcgaccggcctcttcaaaaatgcggattcccggccagactttcggatcctcctgttttttctctgctacatttttgctcagtatgctgctggctcccagcgtctggaaatcactgccgtacatgttcatatatccaatctcgcaggcactgctgctgaacccatggaagaccttcccgtcaatcagaatacatccgcctatgcctgttcccagtgtcaggcagactgccacccgactgccggaggccgctccgttcttatactccgccagccccgcacagttcacatcgttctcaacctcgcaggggatgccgtatgtttcttcgagcacctttttaaacggtgttcctgtgtaatgggggatgagctctcccgaataaaagatctctcctttttcacagtccaccatacccgctgtggagatgcagataccggatatctcctgtttctcccggtacagatcgatgatccgccctgccttctccaatattgcagccgcgccccggtgagcttccgtatctatgctgctcttttccaatattctgccttcttcatccagcagaccatatttgatagatgtaccgcctatatcaatgcttatgtagtatctcatgctctcaccccgcagtaccagtacagcgtttctaatataactgaaccctatacctgcctattttttaatgcttccacgaactgctttgtaataatctgcggcctggtaatggcgctgcctactaccacactgtaaacccccagatccatcactctgcgcactttttccggcgtattgatattcccttccgctataacctcgtgggaaacactgcgcataatctctttgataatcgcaaagtcatcagactcgatcttcaggccccggctctgctttgtatatcctaccagggttgtaccgataaagtcaaatcccatccggtccgcatgcagtgcttcctccaccgtggaacagtctgccatcagcagctggcttggataggcactgcgtacttcctgatagaattcctccagagtcttcccctgcggcctcagcgaacttgtcgcgtccagggctataatctcgggccccactgccatcaattcttcgatctcacgcatcgtaggcgtaatatacacttcgctgtccgcatagtctctcttcacgattcctatgatcggcaggtcaacattcttttttatctccgtgatatcttccttcgtattcgccctgattcctgctgcgccgccttctttcgccgccgcggccatcctgcccataatataggaggagtgcagcggttcttcaggaagagcctgacacgaaacgatcagccttcccttcatttgttcgattcccttattcaatgtcacaccttctctctgataaatttcgccagcatttcagccagtctgctatggctttgggcgtcaagatgcatgtaatcaatctgattcatcgtgacgatatccgcagtatctataaaatcacatccgcataattctgcgcagattttatattccgccgccagcttctccgacttttcactgcatattcccatctcccccgccacaggtgaagtctcacaagccttttcgatcggcccgggagccagcaggaggatctgctgattttcacgccacgcatccgtatgttttgctttcattataagacgcttcatcccgtctgcaatattctttggtgtcgctgaaaaacgctccttacagtcatttgtccccagcataattatcaaataatctatgggagaatgggacatcaggcacggatttagataagccagtccattcattccctcattgagcggatcatcaaatactgcagtccttccgcagagtccttcttctattaccgtatattcctctcccagcagttcccggagccggccggtccatcggatctcatccggaaaccttccatccgacactgcatcatatccccaggtattcgaatctccgaaacaaacaattcttttcctcatggttccgcctttccaatctcgttatccttttaccgctcccattgcaaggccctgcacgaaattcttttgtgccgcccatacgatcagcagtactggtaccagcgtgattacagctgtaaccgccattggcccccattccagtccgcggtccgtgataaaaccggcaatgactaccggcagtgtcttggatttatttacactcaggattacggcaaataaaaattcattccatgccccaataaatgccaggatcccagaagcaatgatacctggtttcgtaatcggaaaaatgatatagaaaaatcgttttgtgaatccacacccgtccagcatggccgattcctccaattcattgggaagctgttcaaaaaatcccatcatcagccagatgacaaggggcaggttgaagcttgtgttcataataatcagagccgtcttcgtatcaatcagatgcagagttctcattaccagatacaccggtatcgccgtcgcaatggcgggatacattttctggatcataaaccacagaccaaaatacttcctcgcctttttaccgattgacccgcgcgcgacagagtatgcagccatacttccaagaagcacggatataactgtggatactgccgcaacaacaaatgtatttaaaaagtgcattgcaagctggtcttttccaaagacactctcatagctctccatggtcagctgattaggaatcagtacgggagggctggccagatagtctgccttcactttaaatgaactggtcagaagccagtataatggaaagaggatcagtatcatgctgacgacaatcaaaactacccgaaccggctttccggcaaaatttccgataatattgtcaatggttggcagctttctgtgtttttttctattcatcacaagttctcctccattctgtctctcaacctcaggaatcccatcgttaccactgtcatcacaactacaaaaatgatggcaagagatgcggagtatcctgcatcaaagaatttgagcccctgtttgtatatgtagttcggcagcatctctgttgcactgccggggcctccgtttgtcataacataaaccgtatcaaatactttgaatgcgtctacgaacctgagcattacgacaacagtcagtaccggactcatcatcggcagaacaatctttctgaaaatctggccgttggtcgcgccgtctacagaagcagcctccagacagtctgacggcagcgctttcagtccggctgcacagataatcgttacccagggaaccaactgccatacattcaccagtattacagagagcatggccgtatttggagtgctcagccaggtaatactgggaatcccaaggaagctcaggaagtagttaataatcccggtggaggaatccagcatcatacgccacagtgtaccgacagccaccggagccataatcatggggatcaggaaaatagaggtacagatccttgcccacatcttgtcggaacagagagccatggccagaaacagaccgatcactacctccagtgccaccgatacaactgcgaacagcagagtatttccagtacttgtaagcaatgtggggtcactgaacatcttgatataattgccgaatccgataaattccggcaccgcattcggcaggttcagtttcaacctgaaaaaacttagatacagggaatacagcaggggaagcagcgcagtaatccccagaaaaatcatggtaggaaccaggaacatccatgatgcaaacttatcgcctctgctctttcggatcacaggagcggcacttttcgttcttttcatcttagccatgctttattttcagtcctttcttgaaagaagattacctgcaggttataaatccgcaggtaatctattccgcaattttatagtaattacagattatagttctttgtaccttcttcaggcggtgcattcttcaatgcatcttctataccttttttcattttgctgacagccgtttcaagatctatctgatctgacatatattcgctgacaacggtgttgagcatggtatctacttctgttgaagccggaattctccaccacaggtttgctgtatccagagcttctcttacagtatccatataggtgcctttgatgccgtcctgctcccagaatgcttttctcggtgacaggatgccatagtcttcatagaattgattctgcttttcagcactcgtgtacatcttgacccactcccaggcaagttcctgattcttggagcttgcaggtatagataaatcccatgcactcagcagagtggttccggtcttgtcataaggaatggttcccagcgcccattttccaactactttggactgtgactcatcatcagctgcctgtacaagtcccaaggtgggccatgtctcgcacacagctgctttgccatccaggaatgccttgattgactcttctgttccccaggataagatagctggatccgcatagttctgaatctctttcagatgttccagcgcctctcttgtctcgggtgagtcaatggttacgttccagtcctcatccgcccaggatccgcccatggaccagagcacatagtcaaacacaccgccaagctggccggtcgtagcagatacggaaataccatatacgccctcatccggtttggtctgtgcctttgcagcttctctgtacttctcccatgtatccgggatgccgtccggcatcagatctgtcctgtaagcaaaaagctgtggagtgcttgcgtttggaattcctgtgattttaccctgccagctaccggagttctccagaaccttttcgataaattcatccatatcgtagttatctttttctataaaatcagtgagttccgtcaggtatggtgcaaattctccgtcccactggctggcaacatcgatcacatcgtatgagcctgttccgctggtcagatccagcagcgccttttcatgcagagtggtataagggaagtcaaccacctctaccgttgcacccgtctgctcttcgaattcatccaccatggacttggctgcatctgcatatacacttgacatatacagaaccgtcagcttttctcctgcgtatggcttgccgctgccgtcctttgaagcggacgtatcttccttcgcttttcctccgccgcagcctgccagcatccctgcaaccatcgccgtacacaataagacacttacaatcttctttttcatgtttttcctccttcaccctttgatatcgcagatatttttgaaagaaatttttttattttatttttaatgaactatttttttcaaatccgcgatattgtttttacttgttgaaataattttatcattcaccattcttattgtcaacagtacataatcaacagtttttaaggtatctttttggttcttttaaccaataaattgtttttttaactgttttataactttaaaaataaaataaaaattttttcttttttcattttttatacgagtttattgatattgttttgacatctttttagccattcttgacgattgacaggaaattttttttaatgtaaaatattactatacccaaagggcatcccgtaactcatgccctgcgggcgggtctgcagctaagctgcagaataaggtttaaaaaatgcgcagattactgcatacctgccccgggaatgtaatgcaagatactcccgggtatcactatgagggaggtttcacaatggctaccacgaatcttatgaccgaaatcacaagcagatattccaaaatgactaaagcagaaaagaaagtcgctgattttgtactgtcttccccccagaccgctctgagctcaactatcaccgatctttccaagctctgcgatgtcggggagactagtgtattccgtttctgccgtacactgtcattaaaagggtatcaggatttcaaactctcattggcgctcagcacttccacccccgaatccctctctaaaaaggaactgatcgacgtggcggacactgacaattgcaaggatactgccgccagagttctccaggcatataatgttgcactggaccaggcatttgagacgctaaacttcaacgcaatcccaaaggtcgtggacctcatgttgtctgccaggagcatcaacctgtttggattcggcggttccgggacaagcgccagcgaagcccgcaacaagtttatgaaaatactgcccaatgtcatctacaactcagacgcacatatgcagctgacacaggccgcccttcttggagaaggggatcttgccgtcattttctgtaattccggcatcaccaaggattgtattgagattgcaaggatatgccacagcgccagggcatccgtcgtgtttattaccatgtttcttaagacgcccgccgcccagtattccaatatcctcctgctatgcggagccaacgaagggccaatggaaggcggttcgattgccgcaaagacggcccagctctttttaatcgatatcttatatgccgaagtttataaaaaactgggcgacaaagcgttggaaaataagaaaaagacatctcagatcattacagaaaagatgatgtagacacaaaaacgacgttattccataaaacatctttattatggaataacgccatttttattttttcgggaatccctttggacatactctatccccaccaggatcagcccgtgaggcggggcagtaactccagccgcctgccggtccttcgcttccagaatatccttcacctgatccggcgtgtagaatccgcgcccgactctcagcagcgtccccactataatccgcaccatgttatagagaaatccatttccgcggatccttatcgtaagttcctccccattttccagaatatccagatcatatacggtacgcacagtatcctctacgttggtcctgacgttgcagaaacttgcaaagtcgtgttcgccaagcagataccccgccgccctgcgcatattttccaaatccaggctgtaggacacaaaatatgtcatccgtcttctgatggggtccggcacccttgtattgagaatatggtactcataagttttaacagtatcacagtacctcggatgccagtcagctggtacttcctcggattttacaatcacgatgtcctccggcatacgccggttcagtgcgtaagccagcctgtcgggcgggatcgtcgtatacgtatcaaaaacggccacattcccccgcgcatgcactcccgaatccgtccggctggcgccgatgacccggatctcctcgcctgtcagctttgatagttttttattcaatacttcctctatcgtaattccgttcggctgaatctgccagccgcagtaatttgtgccgtcataggcaactgtcagtttgatccgtttcatagtccctcaccaaatacccgtaaaaattggccttatattaatccatatccgcgaaccgtacaagagtcttccgcctctcatgccacggcgcgcattgcaccaaaccgctttctatccgggaactgcgtttttaaaaaatccatatgtggaacggcacatagcgccccacaataaataccaataccatgtacaaaattgtgataatatatcccgcccggtccctgcctttgtataccaggggcttcatcttggttcttccttccccgccatggtagcatctggattccatggccatagccagatcatttgcccgcctgaatgcagatacaaacaaaggaaccaaaatgggaatcatggcttttgctttctggatcatattgccgctgtccaagtccgcccccctggccatctgcgctttcataatcttatccgtctcctccagaagaatgggtatgaaacgcagggcaatcgacatcatcatcgctacctcgtgaaccggcaccctgatcttattcagcggatgcagcagcttttcaatcccgtccgtcagggagtttggcgttgtggtaaacgtcataatggacgatcccatgatcaggtaaatcaagcggatcgccgtatatacagaggtctcaaaccccttttccgtaatatggaaaatccagaaatgcaccagctctgcgccgccccttgtcaggaaaaggttaaacagtaccgtaatcaaaagcagaatcatgataggtttcaaacctttcacaataaatttaaacggtaccccgctcgtgtaaataaccgcgcctaaaaataaggttgcaaccacataacccagaatgctcctctgaataaaaagggatatcagaaataaaagcgtacatacaatcttcacccttggatccagtctgtggattgcacttttagccggataatattgtccgattgtaatatctctaaccatgaatactcctcattatctcttctgctgcttcgtccactgttgttgcatccgtacgcacgttcatacctttcgctttcagggcgtgcataatataggtcacctggggggccgcaagcccgacttcttccagttcccggtaatgggcaaacacgtctttcggcttcccgtcaaacatttttgcgccctcattcatcacaataatcctgcccacatatctggcaatatcctccatgctgtgagacacgagaattacggtcatattggtattcttgtgcagataatcgatctgatctagaatatcgtcccgcccttttggatccagacctgccgtcggctcatccagcaccaggacactgggccgcatagccagtacgcctgctatggccgcccgccgcttctgtcccccagagagctcaaagggcgactgatggtagtattcttccggaaagccaaccagctccagggcttcttttgcgcgctcctcacagacctctttcgccagcccctggttcttggggccaaagcatacatcgctgagaacatccacctcaaaaagctgatgctccggatactggaagaccagccccacctgattccgaagttccttcatgttgtatccttcgtcatagatattcttcccgtcaaaatacagcgcaccgctgccggcttttatcagaccgttaaaatgctggatcagtgtggatttgccggaaccggtatgcccgataatccccacaaactctccctgacgaatctccaggctgatatctttgagcgcctgcttttcgtaagctgttcccgggctgtatacgtaattgatatgttctaacctaattgacataatgcttccaccagctcctctgtccgtaatattccggaaggaatctttagccccttctttttgagcgcctctgccagcatcgttacctgcggcacgtccagcctgtactttttcagttcgtccccccggctgaatatctcccggggcgtcccatgcattacaacatgccccctgtccatcacatatacctggtctgcatcaatcacttcctccatgtaatgggttatcagaataacggtcaccttttttcttctgcgcagttcctgtaccgtccggatgacttcttttcttccgttagggtccagcatcgcggtaggctcatccagaacaatgcatttgggttccatggcgatcacgcccgcgattgctacacgctgtttctgcccgccggacagcttattcggagaatgtttcctgtattccagcataccgaccgcctttaggctgtcctctacccttttccagatctcatctgtaggtacacccaggttctccggaccgaatcccacatcctcttctactacagtaccgatgatctggttgtccggattctggaacaccattcccgccgcctgtcggacgttccacagctccagcgggtccttcgtgtctcttccatccacccatatcgttcctcccgagggaaccaggatcgcattcatgtgcttcgccagcgtggactttccggaaccgttgtgtcctagaatggcaacaaagtcccccggggcaatgtcaatatccacgccgtcgaccgcgcggttcatgccaatgacattgccttcttcatcccgcttctcgtattcataaatcagtttttctgaccggaccatcttcatatatggataacgcctccattttaacgtatttactgctcactattgtacggtaagaactggctttttgcaaggtgcagttttggttgctgatagcaggccaccgccaatttataaccattcaggcaagtctgaacggttacgccaattttcttgtttttgaattcattctatattataatatgcacaaagaagatgccgggaggaaaatgtatggaatttcagaaaatcagttccccgtctctccgtgaccttttcgtggagcagctggaacatcttattttatccgggaaattaaaaatcggcgaaaagctgccgccggaacgacagctggccgagatgatgcaggtcagccgcgccgtagtaaacagcgggctcggggagctggaaagaaaaggctttttgaatgtaaagccaagagtgggaactttcgtggcagactaccgccgtaaaggtactttggacacgcttctttccattatgaagtacaacggcggaaaaatacgcaacgaagaaatccgctcgatcctggaggtccgtatcgcgttggatacactggttgcacagctgtgtatcgacaggattaccgaggacgagatccagctcctccgagataagattgaacagatcaaagacgcacagtctataggcgaggcctcacaggctgcgtttgaatttcagcatgagtttgcccttctctcccacaacacgctcatcccgctgattttccagtccttccgcgcacccgtgttcacactgtgggagcgcttctgtacactttatgggattcccatcctgtatgaaaacaattataagctctggaccttcatccgggacagagacacccagggcgcagtcaactggatccaggactccgtcagggagagtatcgatgggaaccggacgctgtattacgattaattttactgctgttgacaataagtatcccaatactgacgaggagcagggcggaaaggtttttaaacgttacaatctgctctccaaggaagagaccggacaacgccaccccgaataccgggatggtaaaaccgtatatggccactttgcccaccgggttatatttaagcagcagagtccaaaggctgaatgcagccgtggaaataagcgccatatagaccagaagcactgtggatttcacagtaaagccatctacatgaccgccaagggcgagccctattgcaataaggagaacgctcccgaataaaatctgataagcggtaattgtcattggactttctctgtcagatattgttttcaatataaccgtgctgattccataagcaacggtacagataaataccatgccctcgcccatcagcgaaaatccatccccccaggcgccgggcgacaggttgatcacgatgactcctgctagtccgagagcacagcctgccccttttttccacgtcatcttttcatcttttagtataaaatgtgccgctgcgattgatacaaacgcattggacgcattgataatagaacctttcgtgccggtcgtatgcgcaagtcccacataaaaaaagaaatactgcacggttgtctgcaggattccctgtcgcaagatacaagggattgatgactttttcatcgtcaggagccgtttctccaggatacatcctatcacaaatgtgagcactccagagaggaagaaccggtagccagcaaataagatctggctcccggttccttctattccaaaccacccataccccactttgatacaaggaaaagcgcttccccatagcgcgcagcaaattaacgcaaggatgcagatcaccgccggattctgcagctttgctgccttctgtggtttcttttccatattcctctacactctttccggttcttcgtactcaactccgaaagtctctaccgttactttcttcataacctgtgcttccagaggcttatcactgtaatctgtagctgtctctgcgatcttttccacaacatccatcccctcagtcagttctccgaatgcagcgtatgctccatccagaaatggtgaacgcctgtgcatgataaagaactgggatcctgctgaatccgggtgctgcgcacgtgccatggagagaactcccggtgaatgcggcaggtcattcaaaaagccgttctgtgtgaattcgcctttgattctatatcccgggccgcccatgcctgtcccgtccgggcatcctccctgaatcataaatccgctgattacacggtggaaagtcagtccgtcataaaatccttttttcacaagagatataaagttattcacagtatttggggcgatgtttggatataattttgccttcataatgtccccgttttccatttcaaatgttacgattggattttccataatatcaactcctcttttctataaaaaaataattatctttattgtagcggattacagtgcattcgtcaatcagccataggtatactattccatatacctgatcaggccgcccttttcctcataccccgtatcccacagatccttcagcgaaaatgtgctggcctccccgtatgtggccaccgtgataagcagatccccttctttctcttcgtatccaaaacacagaaaccagtgccatacaaagtctttgtatattgggtctttgtgcctgagcatcagatacggcacagggaatccggcgtcaatctgcccttttataaaatctgctgcttctgcaaaggtatggctgccgtcaaagcctgacatcttaagccttgtatcaccgcagtcccgcagatatttttcaaatccttctataaacatggacagctttttaacaccgcccacccgcggcctgatgtatggtttcattttcatggaaaactggatgtactcctctttggtcagattttccacatcaaacggatataagtgttttttcccctgatacattgcgaaataaatgcagctgtcgcaggcagtagccgccgcgcagccgccaacatgcatcactacattggtaaaccagtcctggtcccctcctacctcgccgtctatcataaaatagtctaataatttcttcatccttacctccaaagtactctgccgtcaagttcatgttgttttgccgttactttgtccggcacctggctgatgcaaatgtagaataaaatactacgccaagtataatcacgccgccggcaagctcttttatccccggcttttctcccaggaacaaaaacgccgccaatatgccgtagaccgattccagcccggatataatacctgccgtctgcactttcaccgttcccagtccgtcaatatacatagtatgtgccacggcggtgaatactactcccagcagaagaagcaccagaatatctttcccgttgaccgcgggtttcagcaaaaaggccgaaggaagcaatactatgcctgccgtggcctgttcatagaatgccgtaaggctgcttgtatatttctccatgaacatccggttcattaacgataataccgcataggacaagctgccggtcatcccccagactacgccctgcgtcatggtattttccagccggaattccggtacaataaacaaaaccccgcacagcataataaaagcagaaaccacactggaaagccgcagcttttcccgaaagagaaccggctccaaaaacgtaacaaataacggaaacgttgagaatgtcagcgtcccaacggcaaccgtagacgtctgtatcgactgcataaaagtggtccagtgtacagccaatacaatccccgccgtaatcatcaacaggaaatccctgcccgaaaggagtcgcagacattccttttttatcttcagcagaaacaacaaaaacaaagaggagaatatgactctccccagtacgataatcactgccggcagatccacccacttcgcaaaaaggcctgccaggccgaataaaagcactgcaatatgtatcgatgcaagaccattcttccggttttccatccccatttccgcctttccctatatctttctcgatcttttagatcgtaacaccgactatgttatcaaacaaaatatagtatagcataaaccgcggcggcttcaaaggggtcagacccctttgaactttttcttgcattttcactgtttttgttgtatatttaaatcgtaagtagtaagtaataagtagtaacttaatacacggtaaaaaaggaggggtcttatgtcagaattaactttacaagaacgttttgcccttattgcacttaacgcccaggacagcctgcatatgacgacagctaaaaaagccgccctgcgctgtatcgcagcagcggagattttagagaagtatttggatgctgtctggccggaccaggatactttggaacaggaattaaaatctgctgcagatggttcttcccgtatactcaaacagaccgagaaagagatcaaggctatactggctgaaaagaatctgctgaccgagattcctaatcttctggctagtgatttattttatgtaactgccggagttaatatttttgaatactgcagcaatgtggcggaatacacacggcaaacagagggcatgcgcgcggaacttatggaagacggtaatgttactgatgatgtcatctgcctgttttggctgctgcgcgaaagcggatgcttttatgatctctttacccgcgcggagcagggttaccttgccacacggatcaaccagctgtatctggattcgcacttagcaaagcaattattccccatccagacccgtcacgcatttgaagccttcagccaaaaatttctgaagaaaaaggaggaaatttttacaacgccctttggaaccggacttttgttcgcctgcccgtttttcgagcgctcccagtccatcttcattgaggctgacgcctggttctccggcaatgataagcggctggaatgtgtcatccgccggctggaagataagggacacgaggtgcatgtcctgcgcgccgggaccgtgccgctcctgaaagtggataatttccattatgagtgcattcccacacagattgtggtaaaagcccccgtccagggcgtccgtctgcgtcgttatgtcatgtagccgcccgtacattaagaaaagtaaggagagattctaatgtcaagacaacgttctatggaaactatacttgcatctgaatacgtctccatcggtgagctcgtccgtatcaccggtgtgcgttacagcaccctgaagtattataccgaggaaggcatgctgcccttcgaacaggccgaggaaaacctgacccgccgctttccccgtgaaaatgcagtaagacagatcgaacgtatccggagctttcgtctgcaggggctttccatccccgaaataaaggaacagctgggttgatgtgctgactgtgctgtacatgcctggggggtatgaaccgtaacacagctggatggatttaatgcctatggtcgaaatgtacacattttttaaatttttttggtcactcgtgacattgtccattttgtttttttttattatactgaattcagaaagcaaggaaatgctgttttaatctaaaatacaacgaaacaatattttaaggaggctgtacaaatggcaagtttatcattaaagggaattcagaaagtatatccaaatggatttcaggcagtaaaagatttcaaccttgagattgaagatagagaatttatcatcttcgtaggaccatcaggatgcggaaagtccacgacacttcgtatgatcgcaggtctggaagatatttcaggcggtactcttgaaatcgacggaaaagttatgaatgacgttgagcctaaagaccgcgatatcgcgatggtattccagaactacgctctgtatccgcatatgactgtatacgataacatggcgttcggtctgaaacttcgtaagatgccgaaagacgagatagacaagaaagttcgtgaggctgccagaatccttgacctggaaaaattactcgaccgtaagccaaaggctctgtcaggcggtcagagacagcgtgttgctatgggacgtgctatcgttcgtaatcctaaggtattcctgatggatgagccgctctccaacctggatgcgaaactgagagtccagatgcgtatcgagatttccaagcttcatgaaaatctgaaagctacaatcatctacgtaacacatgaccagacagaggctatgacactgggaaccagaattgttgttatgaaagacggcgttgttcagcaggtagatacacctcagaatctttacaatacaccttgcaacctgtttgttgccggatttatcggttctccgcagatgaactttatggatgcagttgtaaatgtagcaggcagtgatgttacactgaccgttggcgagcatgtactcaaggtacctgcttccaagaaaaaagctctgatcgatggcggctataacggcaagacagtaatcctgggcatccgtccggaggacgtacatgattcagaggcatttatcgcaagctcacctgacagcgtaattaaatccaagattaaagtatacgagctgctcggcgcagaagtatatctgtattttgacgtagaaggcactcagatgacagcccgcgttaatccgcgcacaacactgagaaatggtgatgatgctgtattcgcactggatatggaaaagattcacgtattcgataaagatacagagttgacgatttccaactaatgctttagaataatattataataattaagagaggggctgtactataaaagtgcagcctcttcaattctatctatacgagggatgattatggagaacacaccagagcttgtaaaagctttgtccgaactaaaaagaataaccggcatgacgctcgaagtccgcgcagacacgccggaagagcttgaaaatgcgctgacacaagtccgctgtctcgcccaggcataccgggaaaaatacaacaagaatcatttcctgcaaagcctgatgacggacagcattccggcatatgacatctatgagcgggccatccgtctccacatcgatccggaatctcagaggactctatttctggtggaaaccaaaaacgctctggatgatactgtcatagagattcttaagaatttgtttccctcacaggccaaaactaaccttgtttccatgggcgaaaagaacctcgtgatactacgcccacggaagtcctcggacaccgatggcgacatcagccggattgcacacatgatcgtcgacacactgaatatggaggcgctgacacatgtgcaggtcgcatacagtggaagtatcagtacgctcatggaactgcccggcgcttttaaggaagccagcctggcgctgcgtgttgggaagctgttttattccgagcagaccgtatttcctcacgatcagctcggcattggaagactgatctaccagctgccggtaagcttatgcgaaaattttctgaaagagatttttggaagcgatattccggacgcatttgatgaggagacgacatctactatcaacaagtttttccaaaataacttaaacatagccgagacatccagacagctgcatatgcacagaaacaccctcatctaccggctggaacagattgagaaaaggacaggcctggacatccgcagattcgaggatgccatgaccttcaaaattgctaccatggtcattaactatttacaaacagaaaggaactcctgatatgaatgatgctttttatgaacaacttgtagcccgcaaatcccgcccgctggataccgtaatccgtatcctcatcatcgcggccctcgccctgatcctcgtgttttccatgatgttcatcggttttctaggggtaatcatcacagtcgtcctcgctttcctggcatactattttgtattccctaagctaagcgtggaatacgaatacacactgctgaaccacgatatggaagtagatgccatctacagcaaatctaagagaaaaaaactgctcacatttgacatccagcaggccgaaatcatagcgccaaaaggatcaccgcgcttgaactcccagcacccggaaaagaccctggatttttcctcacaggatgccaaagcaaaagcttactccatcatgatccagctgaaccagaaaaacacatgcatcatcatagaaccagatgaaaccatgctgaaccacatgaaatcctggatggggatgaagctttatttggattgagacggataggtgtggctaaaaggggcgctgtatgggggcgcggcagggctctctgggatgcgtattgcggctgtaacaccgcaaaagagcatcccagagagccctgccgcgcccccatacagctcggttcatccaatcggtagataatactccaaataagagggggcttcctgtaacggtgtgcggtgtatatttagttgctgcacgggatctttcttgccactggcgtctaccgccaggatgcacccggcctgcgccgcatacaacatccaagacaggcggacatcaaaccaaatacttacaagccgctaaagccgctaccgccccatctgccgccgctgttgtgagctggcgcacttcttttgtacggcagtctcctgctgcgaacacacctggccgggaggtcatgcagtcctcggaagccagtatgaatccatccgcatccagttttacgaattcggcaaatacctggttctgggggatctgtccgattgccacaaatactcctgctacgtctattttgaaatcttctccggtctttttgttgttcagggtcaggccctctaccatggtctctcctatgatatctttcactgtagcactgagcacgaattctacgttatctcttgccttcagtgcgtctaccagactgctgtcaccgcggaattcatctcttctgtgtaccagatatacctttttgcagtagttggaaagaaactccgcatcctgaagcgccgtatttccgcctcctatgaccgcaacatcacggcctttgaaaaatgcaccgtcacaggtggcacaataagatatgcctgcgccggtgagctggatctctttttccagtcctaagtgccggtgcgtgactcctgtggcgataatcacggttctgcatgggtattcttttcctgcagtctctatgatctttaagccgtcctcatcccggatacccgtgacctgttccatcacggtctctgttcccaacttcatcgcctgatccagcagattcatggaaaattcactgccgcttacacttgcaatcccagggtaattctctacattgtgggaagaagtaatctgccctccgaaattcatactttcaataattaatgtacgtttcccggctctctgtccatatattgccgcagtcatgcctgccgtaccgccgccgataattccgatatcatacataatcagccctccttgttatttcaatacacgcccggtaatttcacagaatacgcctacatcctatcatgatgcgtagattgaactcatgtcagtgggggataccgattcctctccgcccgccactgccgtttatctgttatactctagtacatcgtaaaataagtaactgactcataagctgagataaattctcgagagtgctgctccacaaacgcaggcgtagtgggttacgctgaggcttggggagcagtgctatcggaaatttaggtcggcttatgtggcagttaattattatataatgtactagtgtgcctcggcatacgcttttatattcgaagcatttgccattttctgcacgccatcctcaccgactacaaccagtgtcggagcctgcattacaccgtattttttcacaagttcttcattttcctctgcatctacaatctcataggctatatttgctttttccagagaactggttgcaatcttacagttcggacaggtcttggttgtaaagaggagagttttcatttctcccgccggaacagccacttcttctgccgccttctgtgcctcatgtgtccgtatgctcatcttggaattgctgatatcgtacaccttgcggtccttgaattcctgtgtcttaccatcgttccagttctttacaggacggtagtaccccgtaatacggctgtatacttccgtttcctctccgcagtgcgggcatttgtattgttctccggaaatatatccatggttcttacagatggaataggtcggtgacattgtataatatggcattttgtagttctctgcgatcttcttaaccaatgatgccgctgctttccagcccggcagtttttctccaaggaaggtatggaatacagtcccagatgtatagagtgtctgaagctcatcctgaatgtcaagtgcttcaaatacatcttcggtatagccaaccggcaaatgtgagctgtttgtataatacggtgttccgtctccctcagcagcagtaatgatatccgggaactgttccacgtcatgttttgccagacggtaggtggttgactctgcaggagttgcctccaggttaaacagctctccgtacatttcctgataatcagacagtctttccctcatatggttcagtacatctttggtaaactgctgggtctctgcgcttgtcatgtcttttcggatccattttgcattcaggccggcctcattcatgccgatcagcccaattgtggagaaatgattctcaaaggaaccaagatatctctttgtgtaaggatacagcccttcctccataagctttgatatgacaatacgctttgtatgaagggaacttgctgcaatatccatcattttatccaggtgtttatagaatcctgcctcatcctcggccagatatgcaatacgcggcatgttgatggtaactacgccaatagagcctgtactctctccgcttccgaagaaaccgccggatttcttgcgcagttcacgcagatccaggcgcagacgacagcacatacttctgacatcgctcggttccatatcgctgtttatataatttgaaaaataaggagttccgtacttcgctgtcatttcaaaaaggagacggttattctctgtatcagaccagtcaaaatcatttgtaatggaataagtcgggatcggatactggaatcctctgccctcggcatccccctcaatcatcgtctcgataaatgccttattgatcatatccatctctgctttacagtcaccataggtgaaatcctgctgaacgcctcctactatagcaggaagatttgccaaatcccccggtactgtccagtccagtgtaatattggagaacggagcctgagtcccccagcgtgacggtatatttacgccgtatatgaaggattcgatacatttctttacttccggatatgtcagattgtctttcttgacaaagggcgccagataggtgtcaaaggatgaaaatgcctgtgcccctgcccattcattctgcatgattcccagaaagttaaccatctggttgcagagtacgctcagatgcttggccggtgccgacgtgatcctgcccgtaatgccgcccaggccatcctggatcagctgtttcagggaccatcctgcacagtaaccggtaagcatggacagatcatgaatgtgaatgtccgcattcttgtgcgctctccccacttcatcgtcataaatctcagacagccagtaattcgctgtgatagcgccggagttgctgagaatcagaccgccgacagaataggtcactgttgaattctcttttacacgccagtcggtaatcttcacataactgtccacaatttctttgtaatccagcagggttgaattcagattccgaatcttctccctctgttttctgtataaaatgtaacctttcgcaacatctgcatatcctgcctttatcagcacggactccacactgtcctgaatatcctccacggataccatgccttttttaatctttggttcaaaatctgccgtaaccttcagcgccagcagatcgattatgtcctgattgtattgcttttcctgggcttcgaatgccttcctgatcgcctcccctatcttggcaagattgaagtcagctaccttcccatctctttttgtaacctgatacatattgtacggtcgcccctttctctaaatcaaagtcagataatttttgcccaaccggatccagttgggcatctgaaaatattctatcaccatatttttcacttgtcaacaaagaacaacaatatctagtatgcaactttttcgtttccaactagatatagatacaatttcctatgtaaggatctgacctttcaagctgcatactccgtcccgcgctactttaacatcccatacagcctgcctgaggcggtagacttcactcaactcctctgagttcagcattgggaatatttctttttacaatctccagagcctgttccataatctcttttgtataagcgcgcagccccggcctgatcagatctccggaatccacaaatccctgcagataatatttttcagctccccgaagccaacgtccaatagctgcaaaatcttcccttttatgaaattccctgacaaccgtagttcgaaattcgcagggcaccgctcctgacatcaggaaatccacgctctgcagaatatcttccaaatgataaccctcgatcccgatcgtcataccatatttatttggagcattttttatatccatcgccacatagtcaaccaggcgctgatctacgagccgcttcagacgggcggcactgcttccatttgtatccagttttaccgcgtatcccaggtcctttaccgcttttataaagtcctctatatccggctgtaacaatggctccccgcccgtgatgcatacgccgtccagaaccccctggcgtttcttaagaaaagaaaatacttcttcctctggtatgttatgattcacatccacgtgggtaaccagcgaagcattatggcaaaaaggacaccggaagttacaccctgcggtaaaaatcgtacacgccactttctccggataatccaaaagtgtcagtttttgcaaaccctgaatattcatctgcttactcctcaattttaaaatattccatcatgaccggcatatattcccggctgtattctcccagtgaatagtcccccctgctcaggcaccagtctgaaatcagcgcacgctcacacagagagtaatacttggtaatctcagtgatagacttatcctggcggatctcaccatttttctggccctcctccacgatacctgtgatcagccggtaatacactctgttcctgtccagaaggtgtctctgccccttagcggtcagctgcgtggaatacaaagatgccagcaggtctatattgatcttctcctcgatcatagaatgtgctctgtaattcaggtacaaaagcttatcgtaattattcatatccggatctatctccgcagaaagctcttcgtaaaaatcatccagcactgtagataacgtgctgagcaattcatcctttgtgtcaaaataataataaaatgaacctttggaagtacccgaaagttcaatgatatcgtctaccgttgtttggtcatatcccttatcgtggaacagctgccatgcagcggatacaagccttgctttcacgcccttattttctttagatttcgccataatctccagcccttctttgatagaattcttaataactattttaacacaaaattcaataagtggaaagaaaacctcaaagttaactcgacagagtctgcagaggggtctgacccctctgatgctgattgttagttatttcacaaagagccggattctttttactgaatccggccctttacagatgctttaagcaaatctataaaataaagctcacatattttttgatatctccgtgcaggctttcattgcctcaattaccgcgcttctgaatccattcttttccaggactctgactgcttctatcgtagttcctgcaggagagcacaccatatctttaagttctccaggatgttttcccgtctccagtaccatcttggcgctgccgtatacggcctgtgcagcgaacttatatgcctgtgccctcggcatgccatcggcaactgcagcgtctgccattgcttcaataaacataaatacataggccggtgaacttccgcttgtagaaacaacaacatccatcagtctctccggtactacttccacttttccaaacgcacttaagatactgactgtatacttcagttcctcttctgtcacgtactcattcggacaggcagccgtcatcccctctcctaccattgccggcgtattcggcatagtacggactatttttacctttttgccaaactgttcctccagccaagccagtgtttttcccggcgcaatcgtaattatgatctggtcatccctgacgatctctttgatttcctcaattgcagatgcataaaactgtggttttacagaaaggacaactacctctgacttctcaacaacttccttgttatctgctgttacgttaattccatataaagatctggccttttctcttcccggttcaaagacatccgaaccgataatctcttcagcactgaaaatcccctctttaataatgccgcccataatagcgcctgccatattgcctgttccaataaatcctaatttcatagttgtcctcctcgtttaatttttatcaatcatggtcaaaggggtcagacccctttgaccgcacggtgaaaccgctttctttctctgtaggaatttcttccgtatccatccattctattgttatgaaatgtccctggttcaatcccaccaacaatttgtttatcattggttcccgcccctggatttccatggttaccgtgccgtcccattcatttttcacccatccagtcagctgcagtgactgtgcaagatacttggctgtataacggaagcctacaccctggacacggccataaaatacgatgcgctttctaacttctgacatattcccacctttttactttcctcttatctgatacaaaggtcaggcccctttacagccggaaaagagactgcaccggaaaaccagacagtctctcttttatccatggctgcctgctgttttctacagttcaatctcaatccagtcttcctccggataatccaccacgcagcagtcattcgcataaaccctttccggcagaacaatcagtacatgcaccacctcttcttctaccggcatcggtgcgaggtgccatacgcccgtattcagcttcaccacggttcccttcggcacaacaaaggcttctgtcagctgcggtaccgggtcttttgtcggaggcgctgcatgaatcacaacatctccgtccagcgggaggattccttcccccgtgtaattatgatactctgcagaattaacgatcatcttgtctgctttttctgtgacaagagatgagaaggtgaccgggacccttccggaaacagggagcgctaccttgtcattatagaatgccccaagtgcgttcccctccggctccaccaggttataaaactctccatactttgaaaatgcttccgctgtcagtttctgtgctttgattgttctcatcttatacctccaaggatcttatatttttcttatatcttaccacttaatcctcaaaagtgaaacctgtcatcagacgaaatatcagtgaaaattctgttccgtcctttcaataatctcatcctgcagcgctttactcagatttctgaaatggtcgctatagcctgccacacgcacaatcagatccttgtaatcatcgggatgcttctgtgcctggatcagggtttctctgtcaatcacattgaactgtatatggtgtccatccatgttgaaatacgtgcgcactagatttgccatctgctccagcccctcttctcccgacaccacgcttggagtgaacttctggttcagcagtgtcccccctgtctgcaggtggtccatcttcgcgcaggacttcacgacagctgtcggtccgttggtatccgctcccttctccggagaaattccttcggataccggtttgtgcgccagacgcccgtttgcgctcgccatcatcacatcaccaaaatacacatggcaggtcgtcggcagcatattaatcctgtacattccccccagcatattgggacgccccgttacctggctcctgtaatactcaaacacagagcgcataatatcatccgcatagtcatcgtcattcccgtattttggggccttattgcgcaccagattcgcaatacggtcatgcccctcgaagttatcatccagcgcctgcatcaattcttccatggtaaatgttttattatcataaacatggtatttcacagcggaaaggcagtctgtaatcgtaccgatgcccacaccctgcaggtacttcgtattgtaccttgcaccgccgccattataatcttttcccttggaaatacagtcattcgtaataattgaaagaaacggcacgggcatatattcggcgtaaatcttttcgatcacattgcttcccttaatcttgatatcaatgaaatacttcatctgcttcttaaatgcttcaaacaactcgtcatatgaagcaaaatctgccgcatggcccagcgttaaccccagctgcttaccggtcatcttgtcaaacccattattcaatgtcagctcgaataccttcggtatgttaaaatatccggtcagaatataagcctcatttccaaaagcgcccgtctccacacagccgctggttcctccgcgtcttgcatcctcaagtgattttcctgcgttgagaagctcctgaacgatagcttccgtattataaaatgcgggctgtccccagccttttctggagatctcacaggcacgcttcagaaacttctgaggcgtttttctactgatctgtacattggaacttggctgcagcagcttcatctcgtccatacagtccagaatcagatagctgacattattcaccccattttctccgttcggtgtaatgccgcccgtattcagatttgcaaaatctgtataagtgctgctctccttcaatgtgatccccacttttggaggagcaggctggttgttgaacttcacccaaaggcactctaaaagttccagcgccctgtcatcatccagaattcctgactccacatccttttcgtagaacggattcagatgctgatccaggcgtcccgggctgtatgcatcccagggattcagttcgcttgtcacgccaagatgcacaaaccagtacatttggattgcctgccagtaagtctttggcttgtgggcgggaactacatcacagttggctgcaatctgaagaagctcttctctgcgccctgcatcctcctcctttgctgccagttcacgtgcatatgcagcatatctttccccaagtatcatgattgcatcgcaggccagcttcatgccttccagttcattcttcttatcaaatgcttccgtatcgttcataaaatccagcttgtcgatcgcattctgaatatcttctttgtaatccagaaaacctttttcataaattttcacagagccaaccgtatgtcccggccctctctgctccataaattctgtaaaaatgccggcctcataggcgtctttccactccggtgtcatctggcggagaatacggctcctcatagaacgcttttcccagtatggaatcatgacttcttcctgtactttatagtctgtttcctttaccctaaagttaatcaggtctctgtcgttcatgacatgcatatcttccactgtatgacagcacagctccggaaatgtcggagccgcctgcggggaatcccctttctcccccacaatcagctcgccctcaccgatatacagcgtttttgttgaaaaataatcctttaatacctgtccgcgcagctccggtacagacaattcgccttcatatttcttgtaggtagcggtctcactaagcgcccgctccagatcaatatgcgcaggtgtatccagactcagctttctaagagcctttatgcgtgcattcattcctctttcttccatcttaacctcctatttttacatcctggaatccggctttccggaatagttctacaaaatgattcatttcttccctgtcgggtgcatgcatgtctgccccttcgtagcgcatgcccgcttttaggtatttaccggagcccgtgttatgatatggcagcaggttcactcttgctgcatgaatgtttttctcctgaaggtaacggatcatcgccttcatcgcttcctcattgccgttcacttctttgatgaccggaatacggatatagattctggccccgtcccggctcagcttttccagattttccagaatcagctcattgccggcccccatatactttttgtgcagctccgtatccaatgtcttgatgtcatacaaaaaagtgtccgtataaggcagaatccgtttataattttcatacggcgcctgcccgcatgtatcgatcgtgacagagatcccgtagtgatacagctttttcgcaagcgcctccacaaattctatctcagccgccatcacttctccgccggaaagcgtaacccctccgccggattcctcgtaaaacatctcatctttcctgagctccttcacaagttcattgaccgtatattcttttcccgctatctcccggaggttccggttgcaataatccgtacatatcccacaggccgtgcatttcgccctgtcggtaacggctttttgtccgaacatttcaacagccccgttcggacagacagccgcgcagcctccgcagcccacacatttttcattgtcgcacagcagctccttcttaaaactctgcgtctccggattgtggcaccagacacacctcaaacgacagcctttgaaaaaaaccgtcgtccgtattccatctccgtcatggatagaatacttctgaatattcgttatcagactcatgattccaaccctcgcttgccttatgatgtgcttataaaaacgtaatttagaccaatgtttgtactttagtctaaatttaacacacaccatccattttgtcaataaaaacgcaaaggaaaggaaatatgttgtttatatttatttattgtgctataatttattaaaattcgttctgattataaagggttacacctgagtaagaaggcgcacagagatgattgatacgggatttttctcgtttccaaaaggggaagtcttcccctttttatcgcctgcgcctttggtgcaggtatttttttgcacttgtctatattctgaggatataaggaggttttatggagacgagaattgctttgattggaatcgttctggactgtactgattcggtggaggagctgaaccatctgctcagtgaatatggacagtacattgtgggcagaatgggcattccatatcgggaaaagaatatttccattatcagtattgccatggacgcgccgaatgatgttatcagcgctctttccgggaagctgggtatgctgcctggtgtcagtacgaaaacgatttatgccaagacgaagtagggaactggcagacccgcccgtcaggccatgtgttacggaatgccctttgggtataaaagagtccgggtgccgctttggcgtgcccattaaaaaggagaattttctatgaagcatttgattgataaactggaacagaccggtgcgctttccagggaagaatggacggttcttatccgcggccgcacgccagaactggcaaaatatttgtttgaacgtgcgcgtacagtccggcataaatactatggacacgctgtgtatatccgcggcctgattgagtttacgaattactgtaaaaacgactgctactactgcggaatccgcaaaagcaaccgcagtgcccgccgttaccggctggataagaaggctgtactggactgctgccataaggggtatggccttggctttcgtacttttgtactgcaaggtggggaggatggccgctataccgatgaaattatggcggatatcgtgcaaagtatacggcagcattttcccgattgcgccattactctttctctcggtgagaggagccgtgagagttatcagcttctttttgatgcgggtgcggaccgctatcttctcaggcatgagacttttgatgccgcccactatcggcggcttcatccacaatccctgtccgcagcccaccgccagcagtgtctctgggatctgaaagaaatcggctatcagacaggtaccggttttatggttggttctcccttccagacgccggaaaatctggccagcgatatgctttttattaaggagctggatccgcagatggtaggaatcggtccctttattccccaccatgaaacaccttttgccgaatacgcagccggaacgctggaactgacactgtttatgctggggctgctccgcctgatgctgccaaaagtactgcttcccgcaactactgcccttggaaccattgctccggacggcagggaaaaagggattttggccggtgccaatgtggtcatgcccaacctttcgcccgttgaggtacggggagattacctgctctacgacaataagatctgcaccggagatgaagcagcggaatgccggaaatgcctggaacgccgtatggagtcgatcggctatcaaattgctgtttcccggggtgactcgctcaacacggcggctctgtcccgcagtctgagcgctgctgttgcttcagagtaacacctgaacctgtttctattaaatatatctatacaatcataaatggaggatacctaaatgtatgatgtgaattccaaacatgccgaagattttattaaccatgaagaaatcctggagacactggcttatgctgacgagaacaaatgtaatgaagccctgattgattctctgattgagaaggcgaagaaaagaaaggggcttacccaccgtgaggcctctgtgctgctggcctgtcagatagaggagaagaatgaggaaatttttaaactggcggaacagattaaaaaagacttttacggcaatcgcattgtgatgtttgcgcctctttatctgtccaactactgtatcaacggatgtacatactgcccttatcacagcaagaataagcacattgccaggaagcagctttcccaggaggagatccgcaaagaggtaatcgcgctgcaggatatggggcataaacgcctggctctggaggcgggggaggacccggtccgtaatacgatggattattatctggaatctatcaaaacgatttacagtatcaagcataagaacggtgctatccgccgtgtaaacatcaatatagcggctactactgtagataattaccgccttctgaaagaggccggcatcggcacttacattttgttccaggagacgtaccacaaagagagctatttgcagcttcacccaacaggtccgaaacacgactatgattatcacacagaggcaatggatcgcgcaatggagggcggaattgacgatgtaggcgttggcgtgctgttcgggctggacaaataccgctatgagtttgccggccttcttatgcacgcggaacacctggaagcggcttttggcgtggggcctcatacgatcagtgtccctcgtctgcgccatgccgatgatattgatgcagattcctttgacaacggaatcgacgatgacacttttgccaagattgttgcctgtatccgaattgcagtcccatacacaggaatgatcatttccacaagagagagccagaaatgccgtgagagagtgctccacctgggtatctcgcagatcagcgggggatcccgcacgagcgtgggcggttactgcgaaccagagccggacgatgccaaatccgaacagtttgatgtcagcgataaaagaacgctggacgaggttgtccgctggctgatgcagatggattatattccaagtttctgtaccgcttgttaccgggaagggcgtaccggcgaccgtttcatgtctctttgtaagagtggccagattcagaactgctgccatccaaatgctctgatgactttgaaggaatatctgatggattatgcttcacctgagacaaaggctctcggagataaactgatcgataaagaagtgttgaatgtgcctaacgagaaagcgcgtgcagttgtaatcgataatctgcgtctgattgaacaggataacagaagagatttccgcttctaaactaaattacagggggtatttttatgagtttaaatgcagcaccttcttcagacagagtacatatcggcatcttcggcaggagaaatgccgggaaatccagtattatcaacgcgattaccgggcagaatcttgccatcgtatcggacatcaaaggcacgaccaccgatccggttctcaaggcgatggaattgctgccgcttggtcccgtggttatgatagatacgccggggcttgacgataccggggaactgggagagctcagaattcagaaagcatatcagatcttgaataagacagacatcgcggttcttatcattgacggcacttccggcatgacagatgtagatacggggatactcaaacggattttgaaaaagggaatcccttatgtagttgttttgaacaaatccgatctggcgcctggctccaataccgatttttccgaacgtatgcctgctgtcccctcagacagaatcatcgcagtgagtaccgttaccggagagaatatccacgagctcaaggaactgattgcccggcaggcgccggcagagaatgagcggcggatcgtttacgacttgattaagccattcgactttgtggttctggtcgttccgattgataaagcggcccccaaaggacggctgatcctgccgcagcagcagacaatccgtgatgtcctggaatccggtgccatttccatcgtcacaagagaaaccgaactggaagaaactctggagaagctcggtaatccccccgcactcgtaatcactgacagccaggccttcgaaaaagtggctgctgcggtgcctttagatataccgctgacttccttctccatcctttttgcccgttataaaggaaatctggagaccgttgtaaacggggcaaaggctcttgatacactggaagaaggggatacaatcctgatatcggaaggctgtacccaccaccgccaatgcgaagatatcggaacagtaaaactgccccgctggattgccagccataccggtaaaaaagtaaactatgaattttccagtggaactgaatttccaatggacttgtcaaaatacaaactgatcatccactgcggaggatgtaccctcaacgagcgggaaatgaagtaccgcctgcaatgcgcacaggatcagaatattcctatcacgaactatggaatcgctatcgctcatatgaaggggatcctggatcggagtatcgagattttcaaaggggtctgacccctttgagtaccatattcagaattgttttacaatataaaaaccggttcccgtgtattttcacggaaccggtttttatattgtctgtaaagaaataacaccatacactgcaaggcccgcgccacagaaaaataatacggcagaaatgacaatcagccctattacaactcctggttttcctttcggaaacagtttatccctgtaccccggcgttcgactgtgtagcagataatttccgatgtaaatgcaggccggagccgccgcacacatcatcatatacacccctgcactcatcatggggatcgatgtagattcgtacccaatttcgttccacaccccgagctgcgcataaacatctttcattccaaagagcagaataatgggcaaaagattatttataaaatgaaagaaacaattatagaacatatttccgctttccaatatgatccaagccatgacaacgccgccgatggcagtcgggataaaccggaaaatgtctccgtgaaatgcgccgaatacaactccgcttatcaatatagctacccatttatacttatgtggtttcaggctttttagaaaaattccgcgaaaaattatctcctcacaaaccgccggtgtgaccgctactataagtactgccgccagaaacggtatattcatcatcgcggaactcagccccgcattcactccttgcatttcttccatgaagaaaatgctcacaagcagaacaagtgtcatttctataagaaacgctcccacccacatcaaaaaggtgccaaaaacaccggcgcctgccggtcttctgaatggaaacagttctctcggattcccccggaacgcaagaaccagtcccaatgcggcagcaagcatcagccattccgccaataaagatccgtagatcccaaagggtgacaggatcgtaggtgatactataaaaattacgactgcagctgatgccaggactaccaatccctgccagaccttgagttgtttataattcttactcatttattaactccccctctaaaaacctgcttgttaatcttaaaatgtaaaacaattctgaaaacggagttcaagggggtcagacccctttgcagaggggtctgacccccttaaagcagttagaaactaattaatttctctatttccatcctgcgctgtttcattttgtcgtgctccctcgccctgaggctccgatacttcgggccgttttgggaaggtaatttccgccttatacagatccgcctctgtcgatatctttaggtttccgtgctgcagctcggtaaatgttttcgcaattgcaagccccagtcctgagccttctgtatttcttgatgcatcacccctgacaaatctgtccgtaatttcgtctgtgttgaagctcagctccgtggctgaaatattcttcatagagatatacacctggtggtccagatccttcatctccacatatacgcgggtatgcggcatggcatatttcgtaatattcacaattaggttttcaaaaatcctgtatgttttctggctgtccagccaaagcacgattttgtgttccggaaggctccaacggaaatccaggtttgtttcttttattttattatcatattccaagcccacctgttttagcaaatcaacgatgtcgacccgcataaaattcatggttatatttttactggttgctttgctgatttcgaataaatcctcgatcagaaccttcagccgcagggacttgcgttccagcacgtcaatatactctttccttttatcatcctctgtttcgttcttaaccaaatccgtatacgtgataattgcagtcagaggtgttttaagatcgtgggaaacattggtgatcagttctgttttcatccgttcactctttacttcctcttccacggcttttttaaatccgttctgaatctttttaatctcttcctgaatggggttgaatatccccatatctccttcaatcggtgtatccagatccccttctgcaagctgatttgtggcactgagaagcagcttatacttggattggatatcattagagtattttttcaaaaagagaaatagtacaacggaataaatgatgagcgctacaattccataataccacagactgcatacaactaccaggacaacaaaattgattgcgatgatcttaaaaatcgtccggtttgttttatcctggaaatccaggtgcataagcacgtcatactgccttttgcagaaccgcttaatcccgctccatataccgcctgctcctttctttactttttccccatattcatcaccacctcgtttcatccagcgcagaaaccttacacataaagatctctgcttccaatattcttttttcatagtaagcatcgcactcaaactgacaaagccccagaatgctatgccaaatgttacaaaccacacagccacattcattatggctgacattgccgaattcggcgctccactgctgccggttaaatactctgcagccccgccccccagtgtaatccaaacaaccttggccggataatatatagcacttgccagtatgcccagcacaatcacaacgatttcaaatggagcactgaatactttctctcctccaaacgcaaaactctttttcacagaaagtaataccgctgttactgccaatatggctgcaaacagaaacaaaaaaccgccgaacatagaatttgacatcagtgcagctaccgaagtatcgatattgagcccattgctatcaatataagaattcaagttctcctctgtcacgccataaacgatctgcacctctgtcggctcggaaatcccccgccattcgtaatttgtcacctgctgatccagaagatactgctcaatctcatattctgtcctctcgtccagcatattcccgttcacctggatatcggacaactctccgtcatcctggaaagtaaatgccacgcggaaggcataagtggtatcctctttttttaccagattttctagtactgacttactgttgctctccagaagtgcatttccatcccagtcgaatacttcataatccatatattttctcaaaagatcgaaccggtcgccgccatactcctgtaatacatatgctctgtcagtttcctcatatacctcattgtataatatataattcccctcaattagcccaccggctatctgtatgacctcatcattacttaccttgctcccatccagcctatcctgcatttccctcgaaaatacagggtaagccagaaccatccccacggaacagataagcactaccgcaattgccagcaatacagccagtctatgactgtttttcaattttgtatccaacgccccacaccacctttaaatattttggattctttggatccacctcaattttttcccggatattccgtacatgaaccataatcgtatccgtacttatagccttttcctgccataccctttcataaatttcctccgcagaaaatacacgccccggattctttgccagaagcagcaaaatcttatactcaattggtgtcattttaaccgaattgccatccacaaatacttccaccgtatcctcattgatctccaggccgccgattacatgcacattttccttaggttccagtttctccataaacctccggtaacgccgcagctgtgaattcacccttgccatcaattccattggcgtaaacggctttgttacataatcatctgccccgatattcaggcccataattttatctacttcctcggatttcgctgaaagcattatcaccgggaaatcatacttctccctcagcttcatcgtcattctgattccatccatccttggcatcatcacatccacgattgcaaggtgaatctcctctttctccataacttccaggccttccactccatctgcagcctgaaacaccttatagccctggctttgcaggtaaatctgaacaccttccctgatttctttgtcatcctctacgattaatatatgattcgtttccataacttcctcctgatatttttttcaaaggggtctgacccttttgcagaggggtctgacccctatacgtttaacagtataccacatttcggaatatttgcattcgttggaagctcaggaatgttctttttatttacttcaccgtaattatgagctgctacagtcactgtggaaaacggcagcggtatcacatatttatcccatctccaggtcattctgagttttgcagaataggaaatggagataccgacaaagtcttcttctgcctgctcagacagataaaaggccaattttttaggttcatgccttggccctagggggccgtcaagtgctacggcaatggagcgggttctttcgtatgcgttctgcatgatcactttgagcgccccgaagctggcaaaaccgtccggcactctcagggcatggccgccgctgcgctctatcatattctgaatatagtctcctcttttatcagcagtcacaattacatcgacaggactggtctgtttcgaaatttctgaaagtatcatgttcatgaaaaaactgtcttcgtgccagaaaccgaatatctggcttccgccgcttatcgaattttctgcccactgtattgtaactgttttattaagaagccttaaataaccgataaatagatgccccaacacgttctgcccgatttctctcattttcatatgcggattcctctttctctctctgatttatacactgtgcgtaaagcatttcttcgtaaacggccagtctggatgatctgaatccggatgcagtcagcacggcctgctctttcaatctgccatagttttctatttgcattgcctccatgattctcgcagaccattcttccgtgtcttccgccgtcgcatagccgttttttccgttcactacaatgtcctccactccggtagcattgaccgctacaaccggaatacctgctgcaaacgcctctgccaggacaattccctgcgtctccgatttggaagcaaacaaaaacagttcacaagccccgagaaaatgtttcacttcctgattctctacatttcctacaaatacagtttcctcggaaatccccagttcggcagccatcttttccaattcggatctcatacttccttctccgataaataatacccggaagggctcatccatccgctctttcagcctcgcgatccccttcagcataaaccgcggatttttctcttcctccaggcgggaaactgtacaaaataggtgttttctcccctgcaggtactgctgcctgacagccgtacatttttcttcatcctttatataaaaggaatcttccagacctgtgggaaaaattgccgttggagtcctcgttccgctcttcttcatcgcttcctgcatactgaaggtcggcgccaatatcaaatcgcattgatttgtaaaccaccgcatatagcccggcactaccttttctcttcccaggcggaatatctcctgccacacggcactcttgtcctctacggactgaaacgggcgtatatagtgaagatagtcctcgtattttgtatgatacgtgtatatgacaggcaaatcatactttttccccagatacaaagcaatcggacccacaaacatcggatgatgcacatggatgcagtcaaactgttctttttcaaaggcctgaacgatctccctgctgactattctgggatagaccatgccgttttccatttttctgctgctggtcttgtaccggatgacacgctccctgcgtgtttcctgcagatcttcgaactgttcgcctggccggatgtcttccgtctgttcatattccggggcaaataccgtcacctcatggcccagcttcgcaagttctttcgcctgcctttcaacggaaatgggtacccctcctacgaaaggtttataattatttgtcaacattgcaatcttcattcctaattcctcctctgtctgcacttcttctgccttctcactacgccgcttcggatccctgtctatgccagcagcttaattgctgcatcgccgaaaaagtaaccggccccgacaaataccagattccacaggaaaatgcctaccgttgaacttaccgtatatttcagaaaatccatcttaaccatccctgcaggtatggaaatgatggtccgcaccatcggcagcagcttgctgacaaacacaccgatgcaccccttctcacgcagcatatccatcttcgcctctatcacagcctgttgtttcggaaactttttaaaatagaatcccatcaccttcgggcctcccagccttcccagaaaatacaggagccagcttccggtcagtcccgcaaatactgataaaagcatgacgatcggaaaactgatttccccctttgctgcccagatccctgccaacggcatgatcagccctgccgggaaacccggaagattcatgtattccaataaaacgatcaggtagataaaaaaggcgccatattcaagaaaatattgagtcaatgtttggatattcatagaaacagcctcctttaactgtttctagaataaaacagatttctaaaggaggctggcataagaaccaaaagaaattcttaagaagttataagattttatgaatcacgccccatcttccaaaataccggaatataggctccaaaggaatacagcatgaatcccccgcagagaaggatcatcccattcgccgcactctcaggcagctgcgggaacaatatcagcaggaacatcaccacatacagcacagcagtacacactttaccgaaccattttgccccatccagcatcttccctttccggagcataatgatccccataatacccataaatccctcttttaccacaaacagtaccatcaggacaatcatatacggataccggaaacataaagacaatacaaccgcgccctgggtcagcttatctgcgatcgggtccagcgccttccccacctttgtaatcatatggaatctgcgcgccacaaaaccgtccaggaaatccgtgattccggagattcctataatgactgccgctatatagtaatccgtcacagtttccgctgtcacataccgccatacgattaccgggatcagcagaatccggaaatatcccattaaattcggtattgataacagctgtttgcgtattggtgtgtcttcattcatatttttccgcttcctctctgctcattttctgccatgcttctctttccaatgcgctgtaccaaagggatcaggcatgcctgatatccgtgtactctgaaatttccctgctgatcgtgcacaaatcatccacactcaggtcatggatatcttcatgcccggtaatccgcgcaaatgtcttcaattcctcaaaactgcagttcaggaaattcccaactctcctggcagctgcatctgacttaaacctttccctcaactctggattctgcgttgcaacccctaccgggcagttaccgcttccacagatgcggaactgctgacacgcggcggcaatcaggcctgctgatgcaacagcaacagcatccgcccccatcgcgatcgcctttgcaaaatcagaggacacccgcaggccgccagtgatcacaaggctgatatcatccgccccattttccctcagatacttttttgcacgataaagtgcatagatggtaggcacgctggtagaatccctgaccagtctcgggcttgcgcctgtcgcaccaccccttccgtcgatggtgataaaatccggctccgcgtaaacgcagaattccagatccttctcaatgcgccctgcggcgattttaatcccaatcggacgcccgccggaagccaggcggagctgagccaccaaatccttcaaatcctctttattgttgatttcttcgaactttgatgggctgatcacatctttgcccagaggtttattcctgaccgctgcaatctccggcgtcacttttcctcccggcaggtggcctcccattccgggtttggttccctgaccgatcttcagttcaatggcatccgcgttcctcagattctccggggttacgctgtatttattcggcacatattcaaaaatatacttatgtgctgccgccatctcttccggaagaatgcctccctctccgctgcacatggctgtccctgccattgcagagcctttggacagcgcaatctttgtctccctggataatgctccaaacgacatatgggatatgtaaacagggccttccagcaccatgggcttttccgcattttttccgatcaccgttttgatacttacaggggcatgttcatccagcggaggcggattgagctgtgcgcccagaagcaggatatcgtcccagcacggcatcggcatcttcgtacccattgcctcgataataggttttccgctcactgccatttgatgaatttcttccatataccggcaggaatcgtctttccggtagaactcaggaggatacgccaaaggatctacattcttttccacagaaggaatctcatgttcctttttttcctccgtctccccttccctttcaaatacacggaccggctgtctgcaaaccggacagaccgtcagttccgaaaaaggaacgtcctccttctcctcatcaaaaataaatccacatacaccacatttaaactttgccatattgtatcctccttattgttttatctgattttcccgccgttctgataccagtaattagttctattatagctgttaaaaatttccgggtcaacacaaaacaggaattattattattttcatatattttctgaaaataaagtctgccgcagaaagacaggatctttccgggcagactccttatataaccggttttcagattcgtttatttataatatcgtcaatcatttttgacgcctcatttttcgtaattgtatcgggatcccactccagttgaaccccattgttcagaatcaatttcttcaaaaaaccgatctgtttgggagttgcaggcatggcttttttctgtttataacttagtgttaccggctggaaaagttttggctccttctcttcaaaataatgcgccagtgtctgataaagctttgccgtagccagtgcgtcatgataggctcggtgggcggcacgattctctatgcggtagtaatcacacaggcagcccaggcttttcgattccatatctttatgtacttttctcgcaatcctgagcgtatcaatcccgaagcgttcaaaatccagtccttcggccatagcacctactttcacaaaactgtagtcaaaaataacattgtgcccgatcagaatatcatccccgcagaaatccaaaaagtcaggaatcacattcctgctgcttctggcgcctgcgaccatctcgttggtgattccggtcagctccgaaacaaccggagaaatgttctctgtggggcggacgaattccatgaaacgttcctgcaccttaccatggcgcactttcagtgcgcctatttcgatgatttcattctgttccgggttcagcccggtcgtctccaggtcaaatgcgatatatgatttcagcatactgtttctcctgtatttatccttcctgcaacagcctcaggacatcgaaaagggtgtcaaaccgatgccatgccatttccagaatcgtctcgtcgggttctaccagatccggcaccataatggcgcgcatccccgccgccactgcagaccggataccggaaggagcatcctccagcgccactgcattggccgggtcaaccccgatcgttgcgcaggctttctgatagatctccggacttggtttactgcaggttaccatatctccaaataccgcaccgtcgaaatactcccacagcccctgctcctttaggagagtgcttgcatgctctctgcgtgaagaagtagcaagagctatcctgtacttcttatccgccgcatatttcaggagttccaccaccccaggttttatttccagcccctcttcagccacaattttatggtattctctgcgggtcatcacggaaaaatccgccatcggaaaatcaggatccacatttttcctaaaatattcttcccgtctctttacgttaaacccgatcgtatgatagatatggttcccaaaatgttcatagcccagctttgtccccacccgttcccaggaccgctgcacgactctttccgaattgaaaatgagcccgtccatatcgaagacaagcccatatactggtggttgaatttgactactcaaaataaatccctctgccggtacagtcattgatataggttacaacttcctccagtttcttcacggccgactgcatatcttcccaatcatcaccgcgcagctctttggagactattgattttttaacatctttcagtttatgtatcagttcctgattcttttcccccatgaaatacagctcccttctatacagacattgccttgttgacacctattgtaacacttttttcgtacaaatccaattcctactgttcacggaatttgatcgtcccgctctcagcatccatactctccacgatggccaaagactccagctggaagcccagattcctgatcatacgcccgccggactggaatcccttctcaatcgcaattccaatcccttcaaccacggcccccgcagactgcacaatctgaatcagtccctgcagcgcgcagccattagccaagaaatcgtctataatcaatatatgatcctccggagaaaggaacttctgggcaacgatcacattattcttgcacttatgcgtaaaagactccacctcagcgactaacatctccccttccaggttaatgctcttggactttttagcaaaaacaaccggaacattaaaatgcttcgccacaatgcatgcaatcccaattccggatgcttcaatcgtcagaatcttattaatctgcttatccgcaaagcgttttctgaattccttccccatctcatcaaacaggtcaatatccatctgatggttcagaaaactgtccaccttcaggacattcccttccttcacaataccgtcctttaaaattctctcttctaaaaagttcatccttgtcctctcctattcaaaggggtctgacccctttgctctccattttctcctaattctcgtttgtatgaaatatttcaaaaactttacgcaataagaatgagttcagccaggctaccagtgacacgccgatgatcagccatactgcaatgccgatcagaagattccgtgtgttcaaaaaggtgatgataaccggccctgccgtgatgataagcattaatacggtatatggaagcttagccacggataacagtaccgcatttttgaaggtattcttgatcgtgttctcatagcgcgccgtcagagggaatacatagattaccatacacagccagactacgccgagcactaagaagatgctttggaatattgtacgcatcgttgactgcatgaccgcggaaaaacggatgtcgattccgattataattcccacaaccagcagaatcagccacattatggtgctctttttgaagttctccttaaatgcccccagaaacccttttacaatataaccttcttcgttctttaccagcttcagcattacggtatacatagcggtcgtggatgccccgattgtgatgatcggaatggagcatattatccacatgatgttcagcagcataaaatcgcatacccggctaagcgccctcattacaacgttatcggtccagttcattaaatcttcctcttttctttttgtagtatccgaaaacctcccccctgaagtatttcgaaacgttaatattttgattttacatagaataaagtaattatactttaaatggagtaacttctcaacttcctttttaagaaaatctatgaaattatctggttttgagataagaaattccggaatttatctttgtcaaaaccaagtgggcaagcccagctcaactccccgcccccttactcatgaggggcttgcacgctttggcgccgccgcgatgccgctttggcgccgccgcgatgccgctttgcggctatatatcttatcgcggcgtgtgcatcctcccggagggttttatgatataggaaattccagaggaatttcctatatcataaaaagccttatatcaaaaccggatctccgtttgatataaggctgttttctaagcgggtgatgggaatcgaacccacgtatccagcttggaaggctggtgttctaccattgaactacacccgcgtcatctctgacacgagtgatataatatcataccttcccacaaaaatcaatacctgtaatctaattatttaaatttttttaagactatctctttaaaatcccgtaacagttccggccggcctgaacaactacaggctctccgcaaaatcagtctccctttggaataccggcggtttttccaaacttcttaaaaaactcatccctgggcagaggatgtgaaaaaagaaatccctgccccatgttgcatttaaagccttttagaatgttcagctgttctttatcttcaataccttccgcggtggaaataatctggttcagctgtctgcacatctcgatcgaattttccaccaacacccttacttttggattgtccttcaggttttctaccagacttttgtccagtttaagttccacaaaatccatgtttgacaaaatcgcaaggttagaatactggtagccataatcatccagcgacacaacaaaatggtattttttaagctcgtctattaacgcttgtaatgctgaaggttccatcttgctgatgctctctgtgatctccaatacaagcagcccttccggaaccccgtatctctccctgatttcagcaagactctgtacaatcccccgcttcatcaggctgatacgggaaaagtttaccgacacgggaacgggcttccctcctgctgccatccattcttgcagtatcccgcatacttcctcgaacgcaaagcagtccagaaatgggatcacgccttccttttcatacagcgttataaactgttccggcagataatactctccgtcttcccctttctgccggagcagggcttccgcccccaccatctctcctgtctccagacagatctttggctgcagaaacacctcaaatctgtctgtctctatctccctgacaagctgccttgccacggccttatgataggctggctttcctgagatcatactgccataataagtctgcttctccaaatacatcatattgtcgctgccgccaataagctcttccacatcaaaggtaccctctccaaagttgacccccatagagaaatcacagatgcattcattttccgcatagtccttcagggcttccaaacggctgtaaaattcctcctttgtgccattcacgtacagcgcgataaactcgtctccgccaattctgtatgcattctccggaaatgtctgctttaccccttgtgccacacttcggatcattttatcgccataagcatgaccatagtggtcgttcgcatatttcagcccgttaatgtcacagaaaacaacacccatcgatttcagtttctgtccgcccagctcctttagtttttccatataaaaatttctgtttccgaggccggtaagcgcatcaatcctgcccatttccccgagtttcataatcatgcgccgcttctgtacatcattatatataaaatacgcaaccgactgaagaagcttgatatgttccactccgcgcgtcggatcatccacgcctatgaatccatacagcgtcttctctccgtcattctgcaattccgcctcccatataggtgctgccatcaggcagccaatcccctgttgattgagtatggccgcttccggagccttttcctctacccggctgctcacagacggcagatataccgccccgttattgcggaaaagctccatccaatggccggttacatctctcggaacacgctgcagattctccttctgtggaatgacaccctcattgcaccactcatatgtattgaccaggatgtcttcctcataattacattcaaatatataggatctgtccgcctggaaaaattccccgataatacgcagcagaccattgattgacatatcaatgtcctgattctcagaaagcatatggatacactgcaccagggtctcttcgatcgaaagctttcttttcagatttctatggagctcctcgctctctgtgatatccacgcagatctccaggcggaacaaatgcccgtcgatctcaatcagcttatcccgaaggctgaaatgccttcccagcttttcattataatgcttccatgtatagaacttatctctcatcagataaccattcgtacagaactggcacggcgcactctgcccctgcagcagttcatagcagagtctcccctggtagtcttctcccggttctaaatccagcgtatccttcattgcctgattcagataaatgacttcatatgtctcaggatctgatatatatataatattttcactctcatctacgataacgggataaattttatccttctctatcatttatactcacctgtctttttcaatcattcgcctttgcccggcccctccggcggccgccgtaccgggtctttcatctacgataattatccccataaaccttttgcttcattatacaatactttattgaagttggatactaaaaaacaaatgttgcagccattttttccccggacagcccagataaaacacactaaatagttaacccatcactttttcggctgataaaaccatagaaacgttgtatttaatcacattatcccttaagaaagaggtaccactgtgccctattttggatataataccttagattcttctgaaaagtaaaacaggaactattacggaggaaatgtatgaaactattattcgtcaactcatgtgtgagagcagaatccagaacattgcagctgtgcagggcttacctggaaggcttaaaaaaagaatggaccattcaggaggtggatctgcagaaggaatcccttgtgccatatacggaacaaatgctggaaaagagggccgcagatatccaaaaccatgattactcggctcccgtcttccagtatgccagagagtttgcactggccgatgcggttttgatcggagcaccctattgggatctctcctttccctcttccctgaaggtatattttgagcatatctgcgtaaacggaattacattccgctattccgaagccggtctgctggttcccatgtgcagggccaaagaacttctgtatatcaccacctgcggcggctatattggggaatgcaattcggcggatcaatatataagggatctgtgcgggatgttcggtatcggggatgttcgattctttgcagcggaagggcttgatattgcggaaaacaatgcagcacttatcatggccagggccaaaaaagaattatgtaaattgtaattcctgctccctgccattgctttttgacttcttgtcccaaaagtactataattcataagacattataaaaagggagccgacaaacatgagcaaaagaattgagaagaaaaaacagaagaagcaagcagtaaccgcagcgtccgctgtgcaggcgggcaaagccaacttatatattcaatatcagaatcaggaatacctggctgatgaagtcatcgaaatggtaagaaaaaagtgcatgagtgaggggttacccgaaatggaggatctgtccatatatctcaagccggaagaacggaaggcttattatacctgcggcggaaacagcggagcagtggaggtttagaagcaatcggcaggacggggcagccgcagactgctccgccctgttacgttccgccagtgtcaatcactcttttattttcttttcggtattcctgtggtgtgcatttcatgatgctgcggaatacctttgtataataactctggctctcaaatccggccatctgcgccacctgcatgatactgcagtttttattttccagaaaatccaggcttcttttgattctgtacttcttcacatattccatcgggctctgccccacctgccttttgaacatcctgcagcactccgtattgctgatgctgcaagcccttgctatatcagtcagatagattttctcctctatatgttcccgtatgtatttgactgccttatatatcagctcattcttaggatttttcccaggcctgccttctctggcgcatagtactttttcatacagaatccgccagcatttgagaagcagtatctgtatatccatctcataccccgctgccccggccgcagaatatgattctgcctccagcagaatcgaggcaatttcactgtgccacagttccctcccggtaagacgaatatccgtaaatgcctggtctccagaaaaatatgggaagatataatttgcagagatacgccccgctgcattgtatccaatcaaggacggatggaagattacgaccagatatctgcattcattcgtcctgttccgccggtatgaatggagtacatttccatttactaaaaccccttcaccttctgacattgtgtactctgagtcctctccgatataatccaggcgcccctcaagaacaagtatatattccaactctatatgccagtgcgacaacacctcactgtctctgtaatccgagatctgcttataagaaatataaaaggggaaatcctcgtctaaaaacattcccgtctccatcttcacttcattccgctcaataaattccataaatgttcccccacaattcagcatcatctgccagcggtacatgaatcctccgccccagcttcacttccatacctgcagcggcttttaagtccgcttcaatttggtaagatttttataatatctgtgctgataattatatattatcactttaaacattattataattataatcagagaaaaaagaaagaggtgaataagattatgaagagatctttgaaaaataaccccttttccagattatttgacaccatatcctcttgtatgaaacctgtaatcccggtactaatggcagcaggtattttaaaacttctgatcatcctgattggttataccggattatttactctctctccacaaaccgaagatgttctgtcggcggtcagcaatgccgccttttattttctgccggtttttacggcttactcgtcagcctgccactttagagtcaatccgctttttgccatggcatgtgcggcggttcttctgctgcccgattttatagagcttttgagcacacaggaaaagatccgttttctgtttcttccggtatataaggcttcgtatgcattttccgtattgcctgctatcctcctggtatatgtgctgtcaaaactgaccggatctctggaaaaagtttctaacaaaacattccggacattttttctgccggttattacaataacttttacatccatcattggaattctgttcgtggggccgctctgtacaatcataggaaatgggatttctgcattcatatttgaattgcaggaaatcaacccggttttatcctgggccgtcttttccgcactttccccatttctgacaatgacagggacgagctggatctttacggctattgtgctggaaagcttagggaataccggcatggagatcggctatatggtgagttccttcatttgtgtgacagcgatagccggcgtggctctgggtgcctatttcaatgaacccggctcaccggagcggcacgcttatctttccgcaggactggtagcgctgtttgccggcattacagaaccggcgctttacgggatctgtattcccaaaaagtctctgcttgccgtggcttctgcagccagctttgcgggaggaatttatcagggaatctttacaccgtgcagtacggtgtactcttttccatcggtgtcaacagtactcatgttttatcaggaaggcaatccctccaatctcttccacgcaatttccgccgctgctatcggatttataacagcccttgcactgactattgccgtcaaatatatccgcgggccagaacaacgcgggcaagcccacaagggcttcccaccccctcactcatgaggggcttgcacactttggcgccgccgcgatgcctccttgcagctatatacctcaaggcggcgtgtgcatcctcccggaggaatttcctatatcaaaaaaagccgcacacataagtcatcatacttcgtgtgcggccttcacctatgtcaaggcagcgcctgtccggcaattttctattcttttccgtcaaagcagtacgtacagagtttgcacggtgacagcccaatcgatgcaaccagatcatccagccggtggtagcgcagcgttgtaaaattctggcgtcttcgcacttcctccaccatatcctgataccggctgcagcagggatctgcatactcttccagcacttcccctgtcacttcctcttccctttcctggataatccttcgcgtgattaaatccagctctgacttggagcgggagaagttcagatatttacagccaaacagaagtggtgggcatgccggacggacatgcacttctttcgctccgctctgatacaggaattcggttgtctcatgaagctgggttcctcgtacgatagagtcatcgatcagcagcagcttcttattctcaatcagtgcctgtaccggaatcagtttcatcttggcaatcagatcccgctggttctggttcgtcggcataaaggaacgcggccaggttggcgtatacttaataaatggcctggcgtaggggattccggattcattagcatagccaatggcatgtgcaatgccggaatccggcactcctgccacgatgtccggtgatacgctgttcccgtcccgctttgcaagcatgcttccgcacttgtaccgcatctcttcgacattaactccttcgtaggaagaagtcggataaccgtaatatacccacaggaaggaacacatcttcatctcctcacccggcgggcttactgtctctacgctctccggtgtgataaatacaatctcagcaggccccagttccttataatccgtatacccgagattgatgtacgcaaaattctcaaaggagacacagtaagcaccgtcttttctgccgaccacaagcggtgtgcgtccatatctgtctctcgccgcatacagcccctccgtggtcatcagcagcagcgtcatggaaccatccacaagctgctggacgtaccggattccctccacgatagaatcctttttgcaaatgagggatgcgatcagttccgttgcgttgatctgtccgccgctcatctcctgaaaatgcgtatgtccattttcatatacttttgacaggagctcctgcatattattaatctttccgaccgtcgtaattgcaaagcttcccagatgggactggatcagcagcggctgtggttcgtagtccgagatgcatccgattccgaagcatcccttaagctcctctacatctttctcaaacttggtacgaaacggtgaattctctatattatgaatcgcacgctgaaatccgtttttcccaaaagttgccatcccgcctcttcttgtcccaagatgtgaatgataatccacaccataaaacaactctaacgtacagtccgtttttgaagctacgccaaaaaagcctcccatgtttttgtctccttctaaagtaaaatttcttttgcatataacaggcagcgtcatgaagcatgccctcacagcctgtttccgcatccagtttaacacaaactgattcccagcgtaaagactgtgaggatcagttttccaaatatttatttctgagcttctccttgtccgcatcgctgagcaggatccggctgcgcaggtattcctccatagaaccatactccctgtcaatcacatccagcgccttaaccaaatgcttcacctctgctcccgccgtagagcgcgcggcctgtaccgcttcgtcccctaagcctttatttctcaaaaactgctccatggcttttatattttccttgtaatagtggttggttatctcataatcttccagaatgacgctgcgctcaacgcccagtgcagccaacaccagcacagatccgaatccggccctgtcttttccggcggtacagtgccaaagaactgctccatgctcattttccaaaagaatccggaagaacctggcatatcccttttgggaaaatggtgttgtggcaatctccacatacatatctgccatagcgccgctcagtaagtacttgatggcctcatccggcgtaaatacgccgctcgctgcaactgcggccatacttccgttctcctcgtccagaatcggtacgtgataattcttcaccccgtccatctccgggtccggcgccttgtccctctccggtgtcgtcctgaaatcaaccacatccgtcaggccgtatatgtccctaagccttttcagatcttccggcagggcttctgccagcttccccgtcctcaacagcatgtccattttgattttcctgttatcggctccggtgtatccgccgagctgcctcgcattgccaacaccggtaagccctattgattttaaatccatatgattccttctctgcctcctgtttccgccacattaaccgcatcgtattttattatagaccttttccctctcccgcacaagattcttacatcccacttttccttactccccctgcaaaaggataaaatgattcttatgatagctaagcagaccgtccctctgcattttggagagttcattggacagggcgctgcggtccacagccagataatctgccatctgctgcctgttaaatggaacttcaatctctttttttccctgttttaccgcttcagacgagaggtaggacaacaacctttctcgaatggatttaggcgtaatatgattgatcttctgtgccagattcagattcttggacgccataatcataagcaggttgcgtacaagcctggcatgatggctgcaggaggacgcacagcttctgaccacctttcccacatccagaaacagcaccgctgtcttcatcgttgtaataacatccgccatcataggggccctctggctgcacgcataggtctccgcaaacacctctcccggcagtatatgcccgataatattttcatttccccagatatccggcctcacaatattgacgccgccctccagcagcagccccatccgttctatgtgctgccctgcatggtaaatgacctcccctcgtgcgtatgccctctcctgcgcccccaggcatcccagcatggctttggcctcttccacggtaaccccctcaaacagtttcgttcccacgataaatttataatccataaattttctccgtttcgttgtaataacaactttttttatatttaaattatagtataatgccactatagatacaaggaaaggattcaaatccctgaacagttatataccggcaagtaaaaaggaggaattgaaatgataagaagaattatagaaataaatgaagaaaaatgcaacggatgcggattatgtgcagaagcctgccacgaaggggcaatcggcatggtgaatggaaaagcccgtctgctcagagacgattactgtgacggcctgggagactgccttcctgcctgtccggcagacgcgatccgcttcgtggaacgggaagccgctgcatacgatgccgaggcggtcagggcccatcagaaacacaaaaatacagcccccctgccctgcggctgcccgggcacgcaggcaagagagctgaggccgcacactgctgcgaaggcctccgcgccttctccggcccccacagaatcccaactgcgccagtggccggtacagatcaaactcgtcccggtacaagcgccctattatgaaaatgcagagctgctcatcgccgccgactgcaccgcgtacgcctatgccggcttccatcaggacttcatgaagggcaaaatcaccctcatgggctgtcccaaactagacagcatagactatacggaaaaactaaccgaaatcatccggcagaataccataaaaaacgtcaccgtcgtccgcatggaagtcccctgctgcggaggaatagaacaggccgtagtaaatgcagtacaaaacagtgggaaaaaaatcccctgccagatcataacactgtcaacccagggaaagattttataatggggtgagggcggctggtaggggccgcagggaaatgcacagccaactccatccgcctcccacttcggttcccccaccgctgtgttaccaggcgtctggatgcgcccactctgccgacgcatccgccatctcaggcagtcgccccctcctctatccccgctcagcccagcaaaaaaccgccttcttgaggaattctgcgcagccagctgtgtctttatcataatattctgtaaaccgtgggtccgccacatacatttcagttatcccgatatgcgccttcggggtatactgcttccagttcatacccagccattccttatgaaggcctacgatgtgccgggctttttcaccttccggactttctccggctttcacagctgcatttaactcctcgcggatttcctcttccagacttgtcatacggctgtactcttcttctgtcatattcagcatcctcttgttagattcttccaccgcattgtccccgtatttgcggcggatctcgtctccgtatttttcctcattgctttttatcatttccgttttgaatgattcgaatttttctgcgttgctcattataatttctcctttcattgacgcaattgtctttttaacggcagttatcatattatccagcctggcctgctgcagttccagctcctccagatgttcatggagtgcggccataacatcaaaatcgtcactttgaatgatcgccgcaatctgctccagcttcaatcccctctctttgtaaaacagaatctgctgcagcagctccagctctgtctcaccataatagcggtagcccgattcccttacacaagaaggtttgagtaagccgatcttgtcatagtagcgcagagtacgtgcactgatacccgcgatttccgataattctctaatactatattccatattcatttcctcctgccgtaatttgaatatagcagttgacgctgcgtcaaagtcaatagaaatctaatttttattttattataatactgccatatccattatatcagcccattaaacttcttcataccccgttctaacatctcctaaaacatccacactttacacccccgcccgtcatctaaccccaaaattcgtccgcaggctttagtcatgcggacaaataagacgccgaaaaaccgcaaaggtcccgaaaccacagcccatatacatctactgggacgcccccataccaccaaacgattcaataagctctcccttcatttcgcgccccacccccatccactcaactaaagcctgccaacaattctccattttttttggatatcccctccatcttatcaataaattgctttacttcttccccccttctctactataatgtactttgacaggttaagcctattaaataaaattattttaaaatacacaggagggcaaggtatgtcacagagaacagacattcacaaagtactgattattgggtccggcccaatcatcatcggccaggcatgcgagtttgattattccggtactcaggcttgtaaggcgctgaaaaagttaggatacgagattgtattggtcaattccaacccggcaactattatgactgatcctgaaacagcggacgtcacttacattgaaccactgaacgtggatagacttgaacagattatcgcaaaggaacgtcccgacgcgctgcttcccaatcttggcggccagtctggactgaatttatgttcggagcttgctgcaaaaggaattctggataaataccaggttgaggtgatcggtgttcaggtcgatgcaatcgaacgcggcgaggaccggatcgaatttaagaaagcaatgaatgaacttggcattgagatggcgcgcagcgaagttgcttattctgttgaacaggccctcagtattgcagatgaacttggttacccggttgtacttcgccctgcttacacgatgggcggcgccggcggcggtcttgtatacaacaaagatgaattaaagaccgtatgcgcccgcggccttcaggcgagccttgtgggacaggttcttgtagaagaatccatcctgggctgggaggagctggagctggaagttgtccgtgacaaagaaaataacatgattaccgtctgctttatcgaaaatatcgatcctcttggcgtacataccggagattccttctgttccgcacctatgctcacgatctctgaggagtgccagaagcgcctccaagaacaggcctacaagatcgtagaatccgttcaggttatcggcggtacgaatgtacagtttgcgcacgatcccgtcagcgacagaatcattgtcatagagatcaacccgaggacatcccgttcctcagcgcttgcatcaaaggcaactggtttcccgattgcgcttgtatccgcgatgctggcaacagggctgacgttaaaagacattccctgcggcaaatacggtaccctggacaaatacgttccggacggagattatgttgtcatcaaattcgcccgctgggcatttgaaaagttcaaaggcgtggaggacaagctcggaacgcagatgcgtgccgttggcgaagtcatgagcatcggcaaaacttataaagaagcgttccagaaagccatccgaagccttgaaaccggccgttatggactgggccatgcgaaggatctggatcagaagacaaaagaagaactgctgcagcttctgattactccgtccagcgaacggcattttatcatgtatgaagctctgcgcaagggtgcatccatagaagaaattcacgaaataaccaaggtaaagacatatttcatcgaacagatgaaagaacttgtggaggaagaagaagcgctacatcgggaaaaaggaaaacttccctccgatgaaaagctgaccgcagccaagaaggacggcttctctgataagtatctgagccagatcctggagatcccggaagctgatatccggaaccgccggattgagatcggcatagaagaggcctgggaaggcgtgcacgtaagcggcaccgaagacagcgcctactactattccacatacaacgcggaggataaaaaccccgtcagcactgaaaaaccaaagattatgatcctcggcggcggccccaacagaatcggacagggaattgagtttgactactgctgcgtgcacgcctcactggcgctgaaaaaactgggattcgagaccattattgtaaactgtaatccagagacagtttccactgattatgacacttccgataagctgtattttgagccgctgacactggaagatgtcttaagcatctacaaaaaggaaaaaccgctgggtgtaattgctcaatttggggggcagacccctctgaacctggcagcagacctggaaaagaacggtgtaaagatcctcggaaccgctccgtctgtgatcgatcttgcagaagaccgcgacctgttccgcgcaatgatggaaaaactggaaatcccgatgccggaatccggaatggccgtcaatgtagatgaagcaatttccattgcacagaatatcggatatccggttatggtgcgtccttcttacgtattgggcggccggggtatggaagtcgtgtatgatgatgagagcatggcaaattatatggcggcagccgttggcgttactccggaccgtccgatcctgatcgaccgtttcctgaaccatgctctggaatgcgaagcggatgcgatcagtgacggcacccacgcatttgtacctgcagttatggagcatatcgaactcgccggtgtgcattccggtgactcagcatgcatcatcccgtccgtacatatttcagatgaaaatgtaaaaacaataaaagaatatacaagaaagattgccgaagaaatgcatgtcaagggtcttatgaacatgcagtatgcaatcgaaaacggtaaagtttatgtactggaagccaacccgcgcgcatccagaacagtaccgctcgtatccaaggtatgcaatatccgcatggtaccgctggctaccgacatcattacttccgagattacaggcaggccatcgccggtagccggacttaaggaacagaacattccgaattacggtgtcaaagaagccgttttcccgttcaacatgttcccggaagtagacccggtactcgggccggaaatgcgttccacgggcgaagtactcggactttccgcatcctacggagaggcattctataaagcccaggaggcaacccagaccaggctgcctctggagggaaccgtgttaatctccgtcagcagaaaagacaagcctgaagtcgtagaaatcgcaaaaagcttcgcagaggacggcttcaaaatcattgctacgggaaccacctatgacctcatccgtgaaaacgggatcgaggcggacaaggtaaagaaaatgtacgaaggcaggccaaacgtcctggatttgataaccaatggaaaaatcgacttgattgtaaataccccggtgggaaaagacagcgtccatgacgacagctacctcagaaaggccgcaatcaaggctaagattccttatatgaccaccatggcggcggcgcgcacaacagcaaagggaatcaaatatataaaagagcacggcagcggagatgtaaagtcactgcaggaacttcatggggagatatcttaaaggtatcaggcagacagaaagttatgccggtgcgtagtatcaagcaaaaagacagaaaatgcggctgcattttctgtctttttcttatatgccttgtttcaaccaacgcccgctagcgcctcccattaaggcagtatatgccccgcactcagataaatctcataccactcttcacgcgtcagggtaatttcgcttccaagtgcgatctccacgaggcgtgtcaggttcgttgtacccgcgatcatttggatatgagccggatgccttaagatccaggatgttgctatagttgtcggagtgacatcgtaacgctccgccagctcttccagcagctggttcaattcgggatacttgtcgtcacctatgaacacaccttcaaagaatccgtactgaaacggggaccatgcctgaattgtcatgtcttttagacggcagtaatccaggatgcttccgtcacggtctatcgctccatctgtcagcatattgacttccattccatttgcgatcatattcgagaagggaacactgaactgtaactggtccgttacaatatcctgcttcacatactttttcaacagttcgatctgcattggtttatggttcgatactccaaaatttcttactttaccggatgcattgagcaggtcaaaggcctctgcaacctcttccggctccataagcgcatccgggcggtgaagcagcagaatatccagataatccgtattcagtctcttcaaactgttttctacggactttataatatgctccttggaaaaatcatacataactccgggaataataccgcatttagactgcagtataatatcctcacgcctgaattctgttctctcaaatgcctcggcgaaaagaacttcacattttccgtttccatagatatctgcgtgatcaaaaaaatttattcccagttccatgcatttattaatatactcctcaaggccttcctgatccaggctgttaatcctcatgcaccccgcagcgattaccggaacttcaaggctgctggttcccaatgtcattcttttcatctcttgtatcctcccgcacattttgataaccccagtgtgtatttccagacacgctctaagacaccgcgcctggagataaacaaaagacccaacgaattccgcctttggacgcggcatgtcgggtttagtttctatcattatatgctctaaaaaagaacttcgtcaaggactttgggacaaatccgttgagcttttgtgttggcgcggatggggacgcttaatgacagaaaggttctttcagggttttctgctattcttttaaaggagcgtccccgtccggctgcgtgactaaagatcgttaactaaattccgattttacaggaatggcttaagatctttcataaaattctccagctctttcaccagtcttttagccgcggctttgctttccctggatgcctccggattatcgttgacagcttcgctgatagactggatccccatattacagccatccatcatcagttttgcaatctgctggctgtcatccttaatcatcagcttcatctcagtggtaatccaggaaaataccgacgccatttttcccggctcctgctccggccggccctcctcattaagaagaccggcaatttcatcatccagctccttatatttaccgtcgtatttctcgattacattccataaatcttcatctgtaacgtaatctttcacctgttcaatactgtccgttcccatcttgcagcccttgctgcattcgtccaatagttttattgtctgctcttccacactctccgccttctttctttttttatcgtttagtgtggggaaatttctgaaatatatacctctattcctgttaattgaccggttttatggcttaattctcccccgctgcttttttcacgctatgtattttcagcataacaaacctcgctataggctgtacaatacaaagctcgacagcgaatgatattgaaaaattattttcttaacagggcatacatacagtaatcaaacactttcccgcttttaaagacgccgtttctcataattccttccaacgtaaatccattcctttccaaaacccggcgtgaacctgtattatgagcaaacggctctgcataaattcttacaatatcaaaccgctcaaaagccgcttggcaaagctggcccacggcggcactcatgatccccttcccccagaactcctccgccagccagtatccgagctccgcactcttttcatagacatccgtccccagaaaaatccctatactgcctaccgcatgcccctctacaacaattgccctgcacagttgacgttctccgctgtccgcggcacaggaaagcacatatccctgcgcatcctcccgcgtatatggataaggaaatgcattgcgcagattgcaggcaatcttctcattgtttgcataaaatgccacgtcatcaatatacttctcattccaattgtccagtacaaattccatagttattccccctttattatatcctgtctgattttatccacaataagatctaccgtatccactttcattgcaataatactgctccacaggcgcactccctgatatacataaagaatcgtctccgtcatctgcccaatatgcacctgcctgaactcccctgtctccattccatatgataacagcctctcccagcgtttcaccgccttccggttcatttcctccatataagagctgccgcaaaccagtgaatactcataaatcgcatagctcaatgagctgccgctgtcttgcatctctcctcttaacttatccagctcatgatccaggatccacttcgcgctctcccctgaatccacggctgccccaacaaagtcctctgccccatcagacattccgctcaagatctcctcaaaaatctcccgcgtactcccgtaatgccggtacaccccgcctcggctcatcccgcaggcctcacaaatcattcccatcgtaactgcccgaaatccttcatttgcaaaaatcctataagcagtctcccgtatccttttccgggtcaatattcctttctctgacataatacctcctagtataagccacactatataccttgctgtttcgctggcctgattttccgatagtgcaaatgcagaaaagacatatgtgtcgcttttattatgcgacacatatgtctttttgtcaagcgttaaaattcaaatacatctaagtgtccttatgttaagcggcaaatcaccgcttcttcccggctctggatcatacaaaaaatcaacgtatgtacttttcactctcccacatcatgcactcggacattacacagatccctgcagcgccgcaggcaagcatttccgccacgcattcgatgctccctctcatcccgcctatcgcatagaccggtatttccaccgcagcacatacttggcgcagaaattcttttcctctgggagccagaccaggcttacagtttgtagaaaagatgtgtcccgcgatcagataagccgcccctgctttttctgcctccgccgcctcctgcaccgaatggacggaagccccggcggtttgaaaccaggtaaccgcttccggcctggatgttaagatgtgcagcggcagatgaataccggcactcccctgttggcgcgctgcttctataaaagtatgtggtatacacggcacctcatgtctgtggcagatttcctgtattcttctaaaaagtgacgcgtactcatcctccgtcaaatccttctccctaagcagaaccgcacggggatgcttcttgcaaatggattcgatctgctcctcaaaggggcggcggcacagatgcctgttggtaactgctatgatatgtttgtaaatatccggcacatattgttccatgattttcctccttttttgttaaacatagagataatcactcataacaggctgcaggcccagcttcagcagatcctggtatacctgctccacggagcggccgtcggatatctcaaactgttcgtcacccttttcctggatctcctctacgtgttctccgatcccggtgctcacgcctgccgagatctttgtagcggcaattttgaccagattatctctcacacgggcacattccctggtggatatggtgatgctggcatagggcataaacagcctgtatgcagtcaccacctgcagaagctgcggctcatgtacgtccattggattgatccggtcattatttactatgggccggagccgcggacaggaaaatgcaatctcggcatgcgggtattttctctggagcagccaggcatgcatgccggtggcaaatgcatcttttcggaaatcgtccaggcccagcagggcggcaaatccgacgcctctcatcccccctttcagcgcccgttcctgggaattcaggcggtacgggaatatccgcttatgaccggcaagatgcagtgtctcatatttatctgcatgataggtctcctgaaaaacggtcacgtaatcggcgccgcatttatgcagatatgcatactcatcggtattcatggggtacacctcgagcccgattactctaaaatatctgcgtgcgatcctgcaggcttttcctatatattccacatctgattttgcccggctctcccccgtcaggatcaatacttcctgcaggccgctctttgcaacggccctcatttcccgatcgatctcctcttcgctcagccttgcccggtttatcttgttatggcagttgaatccacagtagatacagaagttctcacagtagtttgcaatgtaaaccggcgtaaacatgtagatgccgttcccaaagtgttttctggtctccctctgcgcacgctgcgccatctcttccaaaaacggcagcgcggcaggtgacagcagggccccaaagtcttccggagtacgcatatcccgcgcaagggccctgcgcacatcatctgcagtataccttgtataatcataggcattcatggaggcgatcacctgttcctggatcccggactccagaacctccatccccggcagataagtcatatggtcaatccggtttttcttctgcagttcctttatctcttcatttaaaatactttcatttacatgatttgctgtactcattgccgcctcctaatcctgcaaaaatccggtgagcggtgaagaagcgcttgcgcctttgtcaatgacccgggccataccggacagatacgcggtacgcccagcttcaattgcctttttaaatgcctccgccatggcagggatatcaccggccgtggcgattgcagtattggccatcacggccgctgcacccatttccatcgcctcgcatgcctgggacggtttcccgatccctgcgtccacaataaccggaagatcgatctcatcaatcaggatctggataaaatccctggtgcagatccctttgttggaaccgatcggggagcccagaggcataatacaggcagctccagcatttgccatgtccctggccgcatttaaatcgggatacatataaggcataacaacaaagccctcttttgccagaatttccgtggccttgatcgtctcataattgtcaggcagcagatattttgaatcgtgaattacttcgatctttacaaaatctccgcatcccaattctctggacagacgcgcaatacgcacagcctcctccgcatttctggcgccggatgtattcgggagcagcgtcacattttccggaatataatccagaatgtttgccatgccgccttcattggcacggcggagtgccaatgtgataatctgggcgccggccttctctaccgctgccttgatcagatccagcgaatattttcctgagcccaggataaaacgggactcaaatgtatgccctcccaggacaaatgaatcatttttacaattttccatttctaaactcctcctattattcttgttttatttgaatagcttttcatgttatctcagtatcagctccgtaatgaggtttgcctcgtgtgctgcacaaactgccactctgggggccattagcccattgccgtatgatggttctgttttttcgtccccgcacagataaaaatgttctgttatcttccgcgtgtggatcgcattgctttctccatatcctgccataccggaagcagcaatcaaatatttttccggatacagctccagtatcccgtttgccagcattgccttagcttccgggtcatcgaaggcttcacatatcatatcatccgccgcaaacaaagctgctatattttcttctgtcacttttatacagtctgtggtaatgtccaggtatggattgatttccgccagctcctccttcagcgcctcggttttgtacattccgatatggcgcataaagtattgctgcctgttcaaattggtaatgtctacccggtcaaaatcaagcagatgcaggtgccctactccgattctggcaaggaagaaagccacattagagccgagccctcccagacctgcgaccgccacttttgcctttgaaagccgctcctgtatttcttttgtatggcgctcttccagcgcacaccttatctcttccctggtcagcatctttccatcaacctcctcctacaaaactgacaacctccagaacatcgtggtcttcaaccagtgtcagggacagcatttttctgggcacaatctcaccattgcgctctaccgccacccgattaacagggaacccctgctgttccaatagatctgatattgtggtatcaggcttgaaatcgatttctttgccattcactttcagcatatcttctcctcctttttatgcagttactattcaacaaagtgtgcatcccgctgggaagcaaaaaaagagttcatgaaagaactacacccgcggtggtgcaccccttcatgaactcctgttcactctcatcggtattgcttatgtaattatgccgctgctatacacggggacgtgcatagtaacattatgtaaactccggaaagtcggtataagaaaacccaaaaacgggaagcgccatcggcacttcccgtaaatatcttacatcagtccctacgttggcattatccaaatcaggtatatgggtcgaagttctcaacttcctctcagcctatctataagctcccctgtttagtttacgtgtataaatatacgctgtttctttttatttgtcaatacttaaaaatatccgatattgggggctgaactgtaacgttactatgcgcgtcccctctcatcgtaatccatcccgcagcgtatttattgcttcctgaaatcttccgtcctcccggatttctgcaactgccccatcggtaagcagcccttccagaatcatctgtctcatttcctttgacgcagcctcctgcccttcctttactttgacagccgccgagaataaaagcggatttggcagcatcacctgccccgtaatagcatctacaaaacgcacaatgctgtccagcgccttttctttctctcccgcccgcagaaagacctcagcaaatattccgtcgctcattcctcttgtacagccaaatatttcttccatctttcggtaaacttcacagatttccagccctttttctgcatctggctgtaccttctcgtccgccagaagcagcaagcaattctgcatctgccctacaagggtgaacaaacgcttctgtatcacttccacagctttgtccttttcatcccgcttcagatataactgcgcccacagcatcgtagtatccgcagtatattccggtatttccttcagaagccgttctcccgtttccagttcctcctctgccagcgccatagatgcaagctggatgaccgcttggtcgcggtatgcgggaatcccgtttacccggatatattccaaaagctcttttctctgctgcttccactgtattttcttttcttctgatgccagcggaaacatcatctcgaacatggtcagcaccgccgaagcattgtatttcagcggtacacttgccggatactgatgaagcagcttctgcagcatctcctccgccgcctcctgcccctgttctctgccggtttcaattactttattaatatgttctgcaacctgctcatcaggcagtgactcttcaaactgcagtaatgtatctaaattggtgcccagcgctcttgccagggggcacagtaatgtgatatccgggcaggaactttctgtctcccacttactgactgcaggccccgaaatccccagtgccgaggccagctgctcctgcgtcataccttttgctttgcggagggcggctatatgcgctcccagattttctttcataagcaagatctccttttctgatatttgtccggcctgacaactttagtatagcctctcatgtaccgtcatacaagagaggcttcgttaacgaaagctctaaaattattaaccatgattcaagtctttataaactacagaaagaaatcatctccactcaatccgtatatgcgcggccgccattgcatttaccggtacatataatggattaaatccttggtcacagcagattcccgccagtaaactcctgtcctgtttccggcttccagaatccttttcagcacctcttcttctactccattttttatcagaagccccgctgccggagtatcgctcctgttctgcagcagcagctgaaaatagcggtatgccccccacaatgatacatgggaaaaatcctgcccgctttcccggaagatcaagtatggaaatgatctaggtatccacataccacacaggtcgcagtaattgtccccccgttgatatcttgtcaatcgcggataacggaaataatcgtgatatattccaaaaacttttgcatatcccaaaagaaagttttccagttcccttgctgttaccccgaagatctgcctctcaatcgcatccaccgtttcttccgccatctcaccctgttgaaatattccataccaggtatccgcgccagtgggatactttacatgaataggcagacgtttaaacttttcatcgccgttatatatctcatcaataaagtcatccagaataatagccccctggtcaagcctgaaaaagccgttaatcttgctcttaacagatctatcaccggagtgctttcccgtaaaatagtacggactcatttccagcatcaattccggcctctcctctttcatacaaacgcctgtataacacaatagtttacgctctgatacaaatgcccatgtcccatgttccggaataacgatttcccgggcaggtactgattccgtgtttacgctgtcatagattgcttttattatttcatccatgtctatacctcgtactttccttttccatgttcatctggtattttctgccgataccggattacagttgttgtgtaatggggtgatttttcagggtcctcctcataacccactttttttataattctatcactaattttcctttttcaccatacccctccttccatttggaagcctgtcagctctccctttatctcgcgcccccagccgcatacaacactatagcttgtatctgcagaaggtttgggataaaatgactacagaatataaattttcacaagcaggaggtagcatattgaaagaaattgccatttacggcaagggaggtatcggcaaatccacactcagtgccaacatctctgccgccctttccattcagttccgctggcaggcgaaggctttttgagaggggaacgctactgccctcgtcactctcccccaatatcatatccacagatatgaacgaggatgacatggtatttggcggaatgcaaaagctcaccgataccgtaactgccatactaagagagaagccaaggccgcgcgccatcgtcatcatcagctcctgtcccgccggtatcataggggatgatattgatatggcaaaatctctggcagaacctggtattcctgtcattacaattaagacagacggcaacctctccggcgattatctgcagggcatgctcatgtgctataccgaactggccaggcagatcattgacccaaatgtgcagcccgaacctaacacggtaaacattgtttttgaaaaagtggttgctaaaaatacggaaaataactttcatataatccgggattatctggataaaatgggaatccgggtaaactgcagatttttatgcaatacatattacgatgaactgaagaatttccgcagcgcttcgctcaatctgctggcccataaagactatacagggaaaaattttaccactcagccaccaccgataaccagacactgcgccagatggaatttgatccgcttaattatcccgaactgtggtattttgggcagccccgggttccctgcacctatctcgacaaacgggattatgtatatggcagcagggataaactgacagaggcgctccattttctggaatctaatatgaactttgatctaatagtgatcgtcaattccccgggggccgccctgatcggcgatgatgtcagagatattgccatggatgagattcagggtactccggtttttacggtggagacccccggctattccagggatatatgggaagggtacagctctgcatgctgccagattatccgagagctgcttcctgacgctcccctccctgtaaatacgggcacacgtaaaaaagtgaacatccttgggatgtccatattccacaaatattaccagggagactgccgggagtttacgaggcttctggatctctgcggcattgacgtgtcctgtattctttgctgcgaatgtacttttgaggaaatcatgggcatgagaaatgcagatttgaatatcgtagtggatacgatctatggaatggatgccgccagactcctggaggaaaaatatcagatcccctatgtctcctgtcccggcgtcccggtaggattctccgccgccgagaccctgattcatcaggtatgcagtctcctcaatgcagactcggccgcctttgtcactgagagtgaaaaatccagagcgcgcgcctatatttatctctcaagactgaattccctgaccggccttccaaagggggtaaaattcgcggtccatggcacctgttcccagtgttacgggtataccgcctttctcatccggtacttcggcatgaccgcggactgtatctcggttctggatccccccggcgccaacagtcctccagcccccgaatatgaggaactctgccggctgctggagaaaacatccatgagcggcgcccttcataaagacatcttgtccaccgatgccgaacttgtatttgcgtacggaaatatcatcgcaaagctgaaggcgatgcatcgtgacttcagcggaatcgagatcagtctgccctcgatgggctataccgatgtcattcctaagacacacctcgggctttcaggcggactgctgttgtgcgaacagatcatcaacgggctgatgttccgataagaagtacggcagacagtcaaatcgactgcctgccgtactgcatatttttcttgtatagcaatgcatagaaatcggtaaaaaaatcctaattcccaactttaatttccaaatacatgccgtaaaaattcaaccgctcccctggcgtcgttgtctaacatttcttctgtagcatccggcgccaagtccctccaaactttaatttccgatcccacagttccgccgctcatcacaaagggctccattactaccgcgccctggtaatcaatatctttcagcgcctgaccgatttccgcccagggaaggcttccttttcccggaacccgcctgttctgctctcccacatggagatgcccaagctgacgtcctgctttacggatagccgcccctatattgtcttcctctatattcatgtgaaaggtatccagcatgatttttacatgggaactgtctaccgcattcacaaactcaagcgcctgctcacaggtgttcagcatgtacccctcataccggttcagaacctccattcccagagtcacatcacagtcttccgctatttttgaaagttctttcatattttttattgcgcgctctaaatctgcttctttgtccatcggagccgccggatccaagggccagtaagagtataagcctccgcccagcacctttatgtccatgagctgcagacgaggcagcagtcccttaaaaaagtccattcccctctttacaacagccgggtcgccggaacaaaggttttgttcctttgtcggcccgtagcctgctgtcatgataatcccttgatcctctgcacatttttttaagtccagaagctgttcgtctttcaagtacacgttccgcagcgccatacaggaaatctctaatacatcaaatcccagctttttaactttctgtatgtaatatttgtaatctgcctgccattcctttgtccaatatgcaaaatatattccatatttcataattgcgcctttctccttaagtttaagatttagttggttgcttatattctgatctattccgcaaaatagatccaaatatgtccgattatacatagagccatcaccacagttaaaaaacggtgcacaagaagattaaggcgtttattcttcgttatggtatggcacagtacaatcagcagtaccatgacagccgcagtcagtgcaccagtaatgaacacacctatatggtgtacctttatcataggaaacacgaatataaagtgcaaaacagcgataacgagtattgcagcacttatgtacttatgcgcctgcataaaaaatacatccgcctttttcagatgcagttttcgcgtcaccgctttcaccagcagcattaaaaaacataaaagacataaataacccaaaataatactcataaaaatccccccagtacttaaatccctcctgcctcatatggcagctttctctcctggcagcatccttttttcgttccggtcaaatcctgcctgtttattcattatataccttattctgcagctttgctgcagacccgcccgcagggcatgagttacggggtgccctttgggtataccttattctgcagctttgctgcagatccgcccgcagggcatgagttacggggtgccctttgggtatacttttctccgcacgaactcaatctatcctgcccaccattttccatgtaatgttcaagctgtcgcttgtagcggctacggtggtaatcatcaaatccaccacccgccgtttatcgtcaaaggatacgcttcacataagagagcaggacattgtttgcgcctgtcagactgtccgccagcttaacacccgttcattcccgtaaagtcggcggcgtcattgacgatgaccgtcccctggcttgtaaacaatgacctttgcaatcaaaccccgcttaatatcccgcaccagttcctgaaactttgggcggtctgtgttcttgccgctgtaccctttgtctgtgtattccttgcagttaccggctttcaatggaaatactgtcctttttgtctaccgattgtcttgcatagatcgcgtctatcctgttattcattttgtcgctccttttcttaaaaaagaaacggagctgctgacatgattattataccgccagcagccccacaaatcaacgatggcttcggaaaaccttacgccccggcttcctcattctgccgcccacagtggagcaagtccactacctcacagatgggatagggtgtgttccttgctatcctgcgggatattaagaaagatatggaaagcggaaaacagccgagtgaagctgtgaccgccgccatgttccaaaccatgcggaacgcattggcgaagcggaagcaaatcccgttttccattgacgatgtaacggcaatggttgccggacagatcggacagcttgcgacgatggacgaggaagccgttgatctattccaacaattagcaaaaaaaatgattacgcaaacagagaaaatgtaactatcttgtcactattaacaaatagatatctgacattttcccaagtgaaactggggcgtggtggtcttttgactgccgcgccccggtttttctatatttaataaaaaattcatagttaagtatgaaaacatacttgatataagtacgatttcatactataatagtagtcgtgcaagtatgaaaacatactaaggaggtaagaccatgcaggaaaaaataaatgaattgttgatggactttaataaaatcaacaaggagtgcgacgaactatatcacaaagtggcttcaaagatggggatttcagacagcgccttttctatcttttataccctttatgacttaggcgatggctgtctgcaaaaagacatttgctatgagttttttgcaaataaacagacggttaattcttctattcggaaactgatacaggagggatatatttatcttgaacagggtgttggccgggataagcacatttttttaaccgaagctggaaaacagtttgttgaaaagtacattgtgccagtcatccaaaaagaaaatgcggcctttaccgccttgaaagaggcggaacaaaaggaacttttacgcttggcaaatatttatatggaaagtttgaggacaaaattaaatgagatttgatcgtattttccatagcagattactgaatttaggaggtaacacagaatgaaaacaattttacggttcataaaaccgtataagttgctatgcttttttacattacttgttatgtttttagatgttgcgggtggtttgctaattccgaccatcacagcggatatgataaatgccggtatcaatggcggcaatatggactacctgatccgcagcggaatacttatgctgatcgtaacaatcgttaccagctctggcgcgttgttggggagttatctcgccgcagacctttcctctaaaattggccgggatatgcggaacgctctttacgataaatcgctcaccttttcctcttacgactttgaacagttcggaacaggctctatgattacccgcacattgaacgatgtaaatgtggttcagcaagggattgtttggtttattcaaatggtactgcctgttccggctgtctgcattatgggaattgttatggcatttacgattgataccatgatgggcggcttattgattggcgcaacgctgtttatcctgcttctggcggtttttgtaacccgtaaagcctcattgatttttgccaaactgcaaaaattccttgaccgcatgaatgttgttcttcgggaaaatgttacgggtgttcgtgttattcgtgctttcaataaagaaaagtatgaagaaaagcgaatgcggaaatcttttgaggattacgccgaggcatcgatcagcgcaaaccgcctgttcgttggattggaaagtattgccctgtttgcaattaaccttatcattgtcgttatcctttggctaggtggaaaccggatcggcgcgggatttatggaaattggcgatattactgctctgacacaatatgccatgatgatccttttttatatcattatggcccagatggtgatgatcttaattccccgcgctatgatttgtgttcggagaatttcagatgtgctacatcttgcgccggaaattcaagatggaatgccgtctgttgataataaccccagtcaaacgaaagaagttatacggttcaaaaacgcaagtttccgcttcgcagacgcggacgagaataccttagaggatttggactttacctgtaaaagaggggaaacgactgctattatcggcagcacaggcagcggaaaatctacgattgcaaaattgattttgcggtttcacgatgttacttccggctctgtccttctgaatggcaaggatattcgcagcatgacgcagaaagaattaagggagcatatttcttatgtgccgcaaaaagcatggctgttttccggcacgattgctgacaatcttcggcatggaaatgaccgtgcaaccgaacagcaaatgaagcacgctttatcggttgcacaatccgaatttgtttatgatctccctgatggtctttactcccgtgtatcacagggcggtacaaacttttcaggcgggcaaaagcagcgtctttcgattgcgcgggcattggcaaagaaagccgctctctatatttttgacgatagcttttccgctctggactttaagactgacgcagcgttacggaaagcccttgcagatgaagtaaaagacgcggcggtgctgattatcgcccagcggatcagcacgattatgaacgcggaacagattattgtgctggaagaagggcgggttgtcggaattggcaatcacgatttcctaatgcagacctgccctgtttatcaggatattgcaaaatctcaaatgaaaggagatgtgaaccatgagtgagaataacaacaatgcagaagttcttacagaagaaatggattttgaaaagccgggtcatgcgtgtcaaacactaaaaaggctgtggcgttccacgggcgatcagcataagcggttagcggttgtgcttgtatcggtaatcctttatacttttctttctattattgcgccgctgtatagcgcgcacatcgtagatttgctttggaacaacattaaagaggcgattacaaacggcgcagtctttcaagttacatgggcaacaggtggccgggatatcgtatttttattgttgatctatctggcaacggctctgttttacacccttcaatcgttccttatgtccagctttgcggaaaatcttaatctccggctacggacggaaatcagcgaaaagctaaatcggctcccactcgctttctttgaccgcaccaaaaccggggcaattctcagccggacagtgaatgacttggataaaacagcggaagccctgcaatcaggaatgttgaagctgtttacagccgttggcatggtaatcggctctctggtgatgatgttccgctttagtatattattgacgcttgttttcttggtgtttacaggaattgcactggcagctacaaattttgtggcggcaaaaacactgaaatcctccatgaaacggcaacagtgtgtgagtaatgtaaccgcacaggtagaagaagcatacagtggccgggttatcataaaagcatttaatcaggaggaaaccagctctgaaaatatgcacaaggccacggaagaactggccgaggctaccaaaaaagcggactttatgataaacgcaatcaatccggcgatccgcctgattaaccgtttcggtcaagtgctgattgcggtattggctggaaaaatgctgctggaaggaagattgaccgtcggtgtgtttcaggcatttttccagtatgtaaatcaggcttcggaaccgctcacggaagctgcctatatggtaaacagtatgcagtccgctttagcttctctggaacggatttataagctgttggacgaggaagaactttcgccggaacccgctctccccgctattgtggatcaggcaaaagggacagtagaatttcagaatgtccagtttggatatacgccggacaatatcttaatgcacaacatcaacttctctgtaaagccaggacagaaggttgcaatcgccggcagcacaggagccggaaagacaacgcttatcaatctgcttatgcggttttacgagttaaacggtggaaaaattactttagacggaaccgatacaaaggatatgacccgttcaaatttaagaagcaattttggaatggtgctgcaagatacatggttgtttggcggcacgattgcggaaaatatcgcttacagcaagccggacgctacccgtgaagaaatcgtagcggcggcaaaagcggccagagtggatttctttgtccgcaccatgtcgcacggatatgatacggttttaagtaacgacgcggaaaatatttctatgggccagcggcagcttctaaccatagccagagtattcctttgcaatccagcggttatcattttggacgaagcgacttccagcgtcgatacccgcacggaaattgagatcggcaaggctatgaaagccctgatgaagaacagaacgagctttgtaatcgctcacaggctttcgactattatagacgctgatttgatcctgtttatgcaaaacggaaatattatcgaacaaggaacacacgaaactttgttaaaggcaaagggggcttatgccgatctgtattatagccagtttgcgtgatgcctttgtcacaaaataaaggcagaaacagtcctatataatgaaattttccgggacacactttgtccacaagtaggagcgtaggacgagaggcgggggctttcatatacgccctgtatgctgatgaaaccggtcctgtgcttgatgttcagcctttattttgttgtcagcagcccccgtttcgtggtctgcgtgtagttccttgtaaactgacataatctctaaagtaaactacaggacttataaactggaatatgcgctccctgcataagccattctcccaaatttaatcgacgtacgcttcataaatttgtgcgcagctggcaaagaaccatctcgcaaagccagagaacaaagagtttccgagagtactctatttttcagacgtttccgcggcatttatgtatatacctactgcaaagaatatgctgttttgtaaaaacagcgcccaatttaattatgggtctatccgacccataattaagaccgccgcttcacagatatcacatctgtttcgcagcggtcctattaagttctcccgcaagcatataatggagctaaatttttatagttaacatttctcaaaatacaattcataccaaaccaaaaacgtataaatggtccagatctttctccagttatccgaatttccggcgatataatcatcaaaaatcgcattaatctcatcaacctgaaaaaacttctccgcagcctcactgcggaacttctccctgacatcctgattatatctgtcgtctgccatccagatacgaatcggcacgataaatcccagctttttgcggaaggcgatctcttccggcagtactttcgccgctgcagtccgaaacgccactttattctgctccgcatttaccttatattcagaaggcatccgtgaggcaatatcaaagatcctggtatcggtaagtggcattctgatctctaatcccgcggctgtactcatcttatacacattgaaataaatgtccccctccagccagatctggatatccacatccgacatcttcgtaagcggatccagcccctgtgtttcctcataaatcccttccgccagctcgattggaagaacatcgggatcatactttttcaaaatcctctgtttctcatcttccttcataatattggtattacctacatagaaggttttcaaattctcgccataacgttccgcattgcggtacatattatacccgccaaagaactcgtccgccccctctccggagtaacatatcttcgtatgttcggccgccgccttacagccgattgcaaaaacgatggctgaagcatcgcccagaggctgttccatattctccatcacataaggcactgccgcaaaatactcttccggcgtaatcaggcggcggaacgtctttcgtccaaggatatcgcccgtcttctgtgccagttttgattcatcaaaccgttcttcttcgtacccgcaggcatccgccgtctctgcatcagacattgccagtacataagaagaatcaacgcctcctgataaaaaggattctgccgtctcatccggggttttcacctcggtcatgatccggccaagcgtggtatggatctcctccgcccattcttcaagggatttgctgtaatccggatgaaattccggcttccaatagcgttctatcttaagctgccttctctgccaggtcagaaaacgcccgggcataagctttttcaggccgcggaaaaatgtagtctctcccgccacgtatgtaaaggtaagatacagctgcagcatctcttcattcagtttcttcacaaatcccggctgctccatgatcttacgaatagaggtaccgtacagaagcttgccgtccgccgtttcataataataaaaaggcgtagttccaaactgatctctcagacaaaacaatttcttctcttcatcgtcccacagggcaaatgcaaacatgccgtgcatatggtttcccatatcatatccccaggtttcgtatgcctttaccagaattgcctgctcacgctcctccctggacagggaaccatcaattcccagttcctcacaaagagcttcccagttgcggatatgaccactgtattcttttattattatcatatgtatgtcctctcgtattaaaattttattgtaacagactgctttttatagcagacttaattcatttattttagcataatataaagcggtcagcaataactagaggagaacaattagcggcggggttccgtcttgttactattcacggggccgtgcaccccgctgcacggcatccgagccaataaaatgatggagccgggcatctgggtcctcgccctaggcggctttaaatggcccagatgccgttactatgcgcggcccctgggccgtgaatagtaactccatcttaatgcaaagagggggacgcttaataacagggaggttcttccgggggctttcgcgattccttcatgaagcgcccccctcctctcgcgagactgaagctcgttcattaattcttatatttgttttgaaaatatccataaaaaaagtgatagaaaattgtacacaatcacgatagataaatatgatatataacgttataatattatgtaataacgttatatccgagaggggaataagaatgcttaaaagaaataaaataaaatacgtttttgttatgcccgcaattttattactgatcgtattcgtctattatccggttataaaaaatatgatctacagtttctataacatgagtgcattttcggttcatgagcattttatcgggttagacaattatcgatcgctgttcgcggatccggttatcaggactgctttaaagaataactttatttatgtattctggtctttgttgtttcaggttggcggcggccttttgattgcgctgtttctggaaagcagctttataaaaagaggaaaagttttcttccgaaccttattttttatcccttctattatttccattacagtgataggcgcgttgtttacttttatctatcagccggacatcggcctgctgaacagccttctgagatttttgggatttgactcacttgcggctggctggctgggcaattcacatactgccttatacgcaatcattgccatgagccaatggcagtacaccggttatgcggctatgctgatcatcgtggggatacaaagggtttctccggcagttctagaatcttcaaagttagatggctgcggattctggcagcaggcgagatacattatcatcccgcagataaaggatacggtcacgattgtgatcatcattacactcaactgggcgatgcaggtcttcaatgagattcaggtaatgacggcaggaggccctggcaatgcaactcaaacactgggaaactacatgtatacggctgcctggtcttatgacaaattcgggtatgcctccgccatcggtaacctgatacttatcattacagtcgtactggcatttctgcagatgaatatcagcgggtttggaaacgagagctgatacgtgcgggaatccgcctgcaggtcatttcctcaatctatctgataaacaaaggaaaacagttcaagagtgaatggagagtacattatgctgaaaaaatctgagtttcatttgaaacagttcgttctatattttatttttatactattttcattatcaattatatacccattattttggattttgtccaattctttgaaaacaaataaagagttttataataatacattctcactgcccggacatcctgagatcgggaactatctgcaggcatggaaagagggcatatccttatactatcttaacagtatcatcgtcactgtcattacggttatcttaatccttttggtttctacactggcggcttatgcagttaccagattcccttttaagtataaaaagatactgctggggatactgcttggaggaatgtttgtttctccgcagactgcggtgcttcccttatatcatctgctcagagatttaagaatatacgatacctatgtggctatgattattcccatactcgcattccggatctcgttttcaatctttctgctgttcccggcttttcattcctttccaaaggaactggaggaagcggctgttctggatggctgcagcagttttgaaatttacaggaaaatcatgctgccggtatgccgtccggcggttaccgtgtgtcttttattaaatttaatatatacctggaatgagtttactttctctttaaactttataagtacggaaaagtattatacgatcccgatcggcctgatgtcattttcacaggctttatacacggactgggtcgttctgctgtcgggtatcgtactggcaattgtgcctgtgcttgtgctctttattgcctttcaaaaatattttgtagccgggcttacagtgggcagcgtgaaagaatagggggacccaagatatgaaacgaagaataaaaataactcttatactggtatttaccatgttactgacgggttgcgccggaccggctgaacaggaggacaaagtcacgttaacattcatgcaccggtggacgatggaaccgatgaagtctgccactgaggatatgataaaagagtttgaaaaggaaaatccggacataaagatcaatgtaatcacggctacaaattcgtcttataagcagaaaataaagaccgtaatcaattcgtccgcaccgccggatatattctttacctggggtgacgaatacctgaataagtttgtaagagaaggcttggtactggacctgtcttcttatatggaaaagcaccaaactttagaagaacttgttccagggcagacggcggcctttcaatatcagggcgggatctacggcataccgctgaaaatcgacgccaaattatggttttataataaagaagtatacaaaaaacttggactggccccgcccggcacgtacgaggagtttttacagcagttgaaagtaatacaagaggccgggattactccgatttatttcggaaactccgacccttatgcaggcgcgcattatttaacaacattaaaccaaaaatgtgttcctgaagagaccttaaaagctgactattcattagaggatggttctttttcggatccgggttatctgcaggcgcttacgatttatgaagatcttcaccaatatatgaatgcagacacggcagcttacgactggagcttttcttattcagggctgattaacggagactgcgcactggtatacgaccaatatgttaccatcgcagattctatggagatggatgcagaattcacaaaaaataacttgggtatcttcccctttcccaccatagagggggcaagaggaaatcagtccattatcactggaacacccgacggctatgctgtcagcagtaaaaccaagcatcccgaagaggcctttcggttcctgcagtatatactctctaaaaagaacactttacgttatttagagagcagctattgggtgaatgctacaacagacctgtttgaaaatatcggccaatatacagacatcgagccattaatagaaggcataaagtatataaaaacctcaccttctacaaccccctggttagatacggaactcgatccgaaaatcgcgcagacttatttaaacggcctgcagcagattgataccggggaggcaacaccgaagcagctgttaaagcagattcagttagctgcgaaaagcgcaaaatatgataaaggtaattaaatgtaagagttcaggcaggcctgaactcttacatttaaacttccctttatgcattttcataattaaaccggtacctggatgcaacaatatactcctgcccgatatagattagttgattctgggtatcgtatatctctgtatacagcaggaataacggatcgccaggcgcaatttttaaaagctgcgcctgtttcgaatccgcctttaatgcatcaatataggagttctgggaacatcccactataataccatggctttttaacagatcatacagcgacccttccaaatcatccgtgagaagaaatgcatattgggtaaaaggaaaataattgttttccaacatgacaggtatctcatccgcatagcggacgcgctgtatgtatagtatggcatcttggtcaaggcttggatgcggtacccgtccgggtgagttcttcgtgagaaccgttctctgggtaactacagccgatggggtcatgccattcacaatgcaggaatttgaaaaactcatattatgttctattttacggaaaatcttccgctcttttacaaaggttcccttcccctgatttttaacaagaagaccgtctttgcaaagttcttcaatcgcacggcggatggtgatcctgctcacatcgtattgtttaattagttcgacctctgtgggaatcttagatccggccggatactctccgctttttatcctggcagaaatatcgtctttaaccttttcaaaaagtggacgcgtcgtattattttcaatattcatcttattacctcaactatatcattatatgtcatggaacattttatcatattcattataacattacaatacgaatatggtatacattataacaaaaaatgtgattaagtgacaaaaatttatttttaaacaagcaattaattgttcatgatgacaaattttatttcatctcagatcccctattgattatatcgtattatgatgatatgatgaatttacgaaaggaaggtgagtaaatggatatggcatgtgatagaattctggtttcatcaagcatatacgattctgtttcaaaagaaccataccagggctatattgtattaaaggatggccgcattagtgacgtaggaaaaggaaagctgcccgccgcttataccgccgggggactgaaggtacaagactgtaaggacggcacgatctgtgccggattcggggacacgcatacgttctttaccggatacgtcatcgacagtcttggtgtgaatctttcccactgcaaaacactgaaagagttgagagactgcctggaatatcatatggaaacagcagcagggaaaggggtcctgttcggcaaccatctggagagctgttttcttcacaacaacagtgtcgataccatgttggaggagatcggacacgacaccgagattgttctctttgcgcccggtcacggaacttgtgcaatgaaccaaaaggcaagacaggcgtttggttttgacccccaacactgccatgcagaggctctttacaagatcatggggctctatctgaatgacagacagtttatcgaccggcagatcgagggttatatgaaactgctcaacagccgcggagttacatctgtaaaagaaatggggtttgacgatttctatggtttcacagacgttttaaaggaactggaggagaatgagagactgacactgagaatatccttcatgtcccagcccgtcggaaagcccgctgatattgagtttggtctgaaaatgaaggaagcattccaaggggattatgtaagattttcgggttttaaccaaatgaccgatggattgattttaaaaatggaaggccatcttcgtcagccgtacgaagggacagacagcgtatgtaacaaggacattgactataagcagctggaaaaagaggtgcttctggccgataaaaacggcctgcgctttacgctccattccgaaggagacggtgcattccatgagatcttaaacatttacgaccagtgtgagcatatcaacggacgcctcaaaaaccggcacggcattacagatctggaattaactgaaccggaggatgaaaagcggatggccaaaatgggggcattcggtgagatctatgcgcaggtatatgcgctagatacttatgacggctatgtcaatgcctatcgagatgtgataggcgcccgccaggagcgatatttaaactaccgttctctggcagaccatggagtacggttgtgcggtgcaacggatctgccattactgattcccagcataccggaatctatattttatggatgcgctaatttcggcagtgataagcaaaaacgtatcaatccacagaatggcctgactatttcagagatgctcgacgcctggactgtgaacagtcagtttgctatggagagagaggatgaacttggcacattggaagccggaaaaaaggcagacatcgttatttttgatcgtgatctgtttaaggttccgatggacgagatgctgaatgtccaggtaaaggaaacgatagtaaatggaaagaccgtatatacccagagggtaccacatcatgcatgccctgcggacaggccggcagagctgaaaaataaggaatgagaataaaacagggaggttcattatgtcagaatcaaaaaaaggaaagttaggtgcacgaacactattcatgttatttatttttggatttgttaacgcaatcatgtactgtttcccctatgtaagatacgtattttatgatcagcagattgcggcaatgggaattacaaatgaacagtcaggagttctgatgtccgcatactcttttgccatgatggctgcgatgattccgggaggaatcctggcagacaaaatttcagtgaaaaaagcaatgctgctctcaatattagggtcgtttgtgctgattatcatttatgcgcttacaatggactttaaaattgcctgcgtcatttggttttttgccggattgacaaccaactttgtattctggtgtgcaatcacaaagggtgtcggtatgattggcacagaagaaaaccagggaacctgctatggaatctactatgcgtcatccggtatcatttccgcaattttgaatgcaatttgcctttgggctagcggattcggcagtgatgaaacaaaagctttcattattgcaatgtgggttatggcagtgggaaccctgatcgcattctttttactattagtcttcttcaaggagaaagaggtaaaatctgataatccgaatgacacgttccagattaagcatatcggggtggtattaaagaatcctatgacctggatgttttcgatcatggtactctgtgcttatgggttgtatacaagcttatcttatttctccccatacctgacagatgtcctgggagtacctttagtaaattcatccttaatcagcattgtacgaagtaatttaatgaatctgctttgccctctcggcggatatgtcattgacaaaatttttaagtccgcaaacaaatggtacgtcactgcatttacagccatgattattatctatgcaggcgttatgatcatgccgggtacggtaagttccggcgcagcaacttttgtctccctgcttcccgcagcagtggcgatgatgctgtacggcgtcatctggtccggtttaaaagaatgtaagtttaaagcggcatataccggcaccgtaatcggtattggttccgtgcttggctatgctcctgacttcttttattttccaatattcggaaaatggatggatacatacggaaatggagcttacaaaatgattttcggctttttgatggttactgctgtaatcggtatcattatggctatactgatgaaattaagaattaaaaaaatgagtgtttcagaaaaataatgttcgtataaaaggagattatgtataatgtttatagaagattttgatgcaggcaagatggtggatgagatccagaataaaaacggcagaattacagaggtttattttgtcgcatgcggaggctctcttattgatttatactccagtaattattttgtaaataaagaatccgttaccatggtcggggagtggattccgagcaaagaatttgtcctgacaccgccaaagcgtctgggcagccactcgttagtctttatctgctcacacggaggacatacaccggaaactgtggaagccgccgatgctgccgccgatgcaggggcatttgtgattacttatacgcacgacgccgaaagtaaatgcgcagacagcaaataccatgctattgtatacaaatgggtcgacgagaccttgcagaaggataaacctatgtgtataacctatgcggttttaaatgaattgatccaccgccaggaacccgaatataagctgtatgaggctatgaaagacggtattgttaagtgtgaccagatcatccgggatgccacaaacaaatatcagaacaaagcatggaattttgctgaacactattatcaggcgccgtttctatatatcatgtcctcgggagctgcatatgcacagtcttacggttttgctatctgctcgctgcaggaaatgcagtggatggactgctgctacctgaattcggcggaatatttccatggcccgtttgaggttacagatgaagaccacttatatattttgatgatgtctgtcggcaaaacacgggaaattgatctgagagccaaggcatttctggataaatatgcaaagaaatatgaaattatcgatgcggcggagtgcggacttgaagggattgccgcggaatgcgtggactacttcaatcctcctttgttctacgagatgagtgtattgtacagaacagcaattcaaaataaaaccggacaccctctggatatgagacgatatatgggggtagtggaatattaaataacacggcttgtcccggagatcattcgatgattccgggatgcccgttttaattgcaaaggggtctgacccctctgctcaggattaactgcaaaggggtctggcccctctgcacaccctgcacaggattggaggttaaaaacatgaaatacgatgttagtgtagttgggtttggagataatgtggtggatatctatacgcacacgaacacacaatatcccggaggaaactgcgtgaattttgcagtatactcaaaaatgttcggcgcccgcagaagcgcatacatgggatatttcggcgatgatctgaatgcggatcatgtaatatctgctctgcgcacggaacagatcgagctggtcaaatgcaaaaagattcacggtgaaaacgggtattcccgctgcaaattggaagatggcgaccgggtgttcctggattataacgaaggcggcgtaagaagcaggcacatctacgaattggacgagtttgatttggaatatctggcacagtttgatttggttcactgtggaaactactgttacatggagagccagttatctaagatcaaggaggccggtattccgctatcgtttgatttctcggatgattcaactgatgagtattatgaaaaaaacgccccactcgtaacctatgccttctgttcatttgacggaacggataaagaggtgcgtcagcatttaaaaaaagtagcggcatttgggccggaaatcgtatgcgcatcccggggagcgcagggctgtatgctttattcagacgggaagttctatacgcagaaagcggcgccccttgaaaaggttgtggatacaatgggcgcaggggactccttactaacaacattcatggtcggatatctggatgcggtgaagcacggcgcggatcgggaagaggcactgaccggaagcatagcaaaggctgccggatttgcagcaaacgtctgccagatggaaggcgcatttggctatggaaaagaagtgctgatcgataaattgagagcttagtaagggtataactctgacagataaaaacgtttaaattagatagaaatagaggaagcggaatccgcttcctctatcttttatgttctctgctgccccgtccggattgcagggaattccctgaccgcaactaaaactccgtatcgtagtcccacggctgtcctccggcgatacaccctccgtcaacccggatttccgtcccggtaatataagaagatgcatccgatgccagcatgatacacacccctgtaatatcttccggatatcccggcctgtctaaggcaatcctttccagcaaatacttggagcgttccggatgctcccaggtaggtactgtcaacgcagtctgaatatgtccgggacttacacaattagcccgaatattgtatttggcccattctacagccatagaccgcgttaaggacagaacaccgcactttgtagcgccatatacagaacagccgccaaggatacttcccgtattatgggaaccaatattaatgatactgccttttctttgatttttcattaatggggccactgcctgggtcaccaaaaaaacacccttcaggttaatatccatgatcctgtcatatgtctcttccctgacatccataaacccttcccgtttattgatccccgcgcagtttaccagcacatcaatctgaccataggctttgccgatcttatcgatgcattctgttacgccagccttatttgttacatccagcaaatagcttgatgccttaccgcccgcttctgttattttattttgaatatctgaaagcaggttttcatttatatcgcaaagagcaatccgggcgccggcacatgccatgcccaatgcaatggcgctgccgattccacccgctgccccggtaaaaactactactttatcttctaatgaaaacatcttctccaggtttttccctacgttcattcttgaatgcctcccttggccttaacacatacatccgctgtcttttcataatattttgctatcgcgctgtgatcctcctgtccatgtccatcggcatgaagcttttgaagcatctccatcacactggctgttaagggaagcggaactccaatttcatggcctgtatctaaggcattgttcaagtccttaatatgtaaatcgattttaaaacccggcttaaaattccgctccataatcattgggattttcgcgttcatgaccgtagaaccagccaggccgcccttgattgcatcaaacactttttctggatcaacacccgcttttgtgctaagcataaaggcctcggaaacagccgcgatgtttaatgcaacaataatctgatttgcaagctttgttgtattcccggcaccaatctccccgcagtatactgcactatttcccatcgtcatcagtatatcatatacttgttcaaatacttccttcttgccgcctgccatgattgacaatgttccatctatcgcctttggctcacctccggaaacaggggcatccaacatttcaacccccttttctgcgcatgcggcataaatctcctgggaagctaagggtgcaattgaactcatatccactaaaatgcttccggccaatgcgccttccagtatcccgtctttccccataacggccgttttcacatgaggcgaatttggcaaaaccgtaattataatcttacactccccggcaaccgccttcgcagattcgccttttattgccccatactttaccatctgttccatgttttcttttattacgtcgtagacaacaactgtatgtcctgcttttaataagtttgcagccattggttttcccatgatacccagcccgataaatcctattttcatgttagactccttccgatccatcctcattgaacaatttttttgtacgcatctacccggctgcctgtaaatccatctcctcaaccactgtcttaatatgctcttttgtaagcccatgatatgcaagtacatcctggtaattatgcgcgctgcatccaaaagtatcttctattcctacaaattctattgggatgcattctttttttagtacctcggctatagcgctccccagtccgccgacaatgctgtgttcttctgccgtaactacgcctttacagccttttgtaatctgaataactgcattggcatccataggctttatggtactgacattgaccactttcacagagatacggtcctccagttcccttgccgcctgcattgcaagaccaaccatatatccggtagcaaaaaccaccacccgggttccctcttttaaaactgttggcttgccaattttaaactccactccctcttccgttacattttcgtagtcatttcgattcagtctgatataacatgggccttccatttctgtaactgcctttacggcagattttgtctcattggcatctgccggtgagatgaccgtcatattcggaatcgccctcataattgcaagatcctcaaccgcctgatgagtcgctccgtcgccaaaatcggaaagtcccgaagaagaaccacagattttaacattcagattcccaatggcaatggtctggcggatctggtcaaatgcccgccctgcggcaaacacagcgaaagaattggtaaatggtatctttcctgtctgtgctaatcctgctgcaaccgatgtcatgttagcctctgcaatacccatctcataatgcctgtcaggaaattctttttcaaacatctttcccattgtggacccgcccaaatctgcatccagcactacaatgtccctattctctcttccaagttccactaacgcttctccataagcaatcctttgatttttacagctcatagccatcctcctctatgccagttcttctaatgcctgctcgtaagtctcggctgtcagcattccattatggtaaccgacaacattttctgcaaaactgatgccttttccctttactgtattggcaattatcaccgtaggccgttctcgttccaaatcggcttcatccagagccgtaagaatttccaccatattatggccatcaatatccagtacattccagccgaaacttctccatttatccggcaggggattggagtccatgcgttcctttacgatgccgtttgcctgcaggttgttcttgtctacaatcgcaatcagattatccgctttataaaatcctgctgccattgcagcttcccatatctgcccttctgccaattcaccgtccccgatcagtacatatacattcctgtctatactgtctgctttcagcccaagggccattccaagcccaattgacagaccctgcccgagcgaaccggttccggcctctattcctggtgtctttctgacatccggatgcccctgcagataagaaccgatctctttcgtattctttagatcttccaccgggaaaaatcccgcttcagccaaagccgcgtactgcagaatagccacatgtcctttgctaagcaagaatctgtccctatccgtcattttaggattcctgctgtcatagtgcatcttataaaaataaagtgccgccacaatatctgctgaagaattggagcctccgatatgccccgcaaccccgattcccatactgataattacatcacgccttaatacttttgcctgttttgtaagcctgctaatcagctcttcactgtatttcattttcaaacccccttttaaagatcatcaatactttcgtatactacaatttttgtacggactgtaaaaacagtgtacagccctttattgaaaagttaccgttattctaatttttgtatttcaatctccccctcatattccgcacagagaaccatatccttatccagcttcccattcttgggcaaaagaaccctgaatcggtattcatccctcgccggctcatagctttggaaaaactgcagctcttcacaattgtctaatatcgttactttctttatctttgtttttaagccggttatcagaatttcatacggaaattccgggtatttaaatacatgtaaaaacatcttgctgtcattgccggttactctcccccagcttatttcatactggaagtccatatttaaattgcacttatagatactttcgccattgaggtcaagccaccggcctgcttcatccagtactttacagctgccttccggaaccttccccttctcgtccggcccgatatttaataacaggttcccgccttttcctactacatctaccaatttatacagcacgtctgcagcgctcttccagttatgatctacccgggaatacccccaggtatcattcagggtcattggagtctcccagtcacccgggaaagaaagaaccgggatttcattatccgacatctgtctgtagtcgcccagtttatatccaatccgcccgttaaccaggcagtctggctgcaggctctttgtatacgccctcaattcctcacataattggaccggcatcacatacggagtatcaaaccacataattccaacctttccataatttgtaagcagctctttcacctgtggttttactttgttatagaaatatttttcaaaatccttctctttatccggcttgaaatcccattcattcccccatccattttcatcttcccagtcctgcatctgagagtagtaaatgcctagtataattccctgttttcggcattcttctgccagctctttcaatggatcccgttgaaagggcgtgttcataatgttataatcagaaacttctgaatggtacattgcaaatccgtcgtggtgctttgctgtaaatacaatatacttcatcccccacttttttgctttccctacaatatcctctgcgtcaaaatccacagggttaaatgtttctgccaacttcctatattcctgaagaggaatttccgcatttttcataatccattctgccccatacggaatcttttcccctttatagacgccaccaagcatggaataaattccccaatgaataaataaaccgtatttagcgtccttaaaccaatgatctcttgccattttcctttcctccttctatcctttaactgcgccggacataacgccgctctggatttgattatggaataatacatatataataatgactggaataaccgataaaataataaaagcgtactgcggtcccatctgcgccgaaaattctccccaaaaggacagcatcgcccttggaactgtatacttggccggatcagaaatcagcgtaagtgagaaaacaagttcaccgtatgcatagataaaagagaaaatcgcttctgtagcaataatcggcttgcatattggcagtaaaacagaacgtaataaccgaaaatcactacacccatctataatagccgcctcatcaatctctctgctgacagagtccagaaatccggtgaacagaaagattccctgtgcaagattaaagcatacataaactaaaacaaggtaagcgaaattatttttcagaccccagcttgcggccatagatgatatgggaattaatgttgaatggatcggtaccatgactcctactacaaatagcatgtaagcatgtctcgcaaagaaaatatttcttttccttgaaatcgcataggctgccatcattgctacgattacttctatcactgttgtcgacaatgccacaagcagtgaattcccaatcgaacggaaggaatgtcccaactcattcgccaccacataattctctattttccagtgtatcggcagattcaacgcgcttcgatacatctcatcatttgtcttaaatgacgaaataaatacatacagtaatggaataattgtcgcaagaagccagactccggctattgcatataatatcagttttttccaacttcttcttttcactcttataccccctctcaatattcttcctgcttaaatatcttgttgcagcagatacttaaaactactcccagtattaagagtatcattgcgatcgctgcactgcgccccatcaatttaaaggaataggcatttaaatacagcaggattccaggggtggaactggccgcattcggacctccgcctgtcatagcccaaatcatatcaaattgcttgatacagcctgtaatacataagattgaatagaccttaaaagaatttttacataaaggaagcgtaatatagcggattctctgccatgccgagcagccgtctatgactgccgcctcattaagtgcttccggaattgtcaccaggccggaacagaaaatcagcatattataggcagccgacttccagcagtttactaaagcaacaatccatacatttaaccctggggtgttcagccagtcaaaatccatggactgcaggcccaggttacggataatctccataatagccccatagtttgggttaataaggttcttccacataacagcaacaatcgtagtccccagaattaccggaagataataaacggttctaaaaaggtttttccccctgatcttagatgttaccagaagagccaagccatatgaaagcggcatctgtataaaaaagcccactataagaaatatccccgcgtttcccagtgaacgccaaaaagttttatctgaaaaaatgaatctgtagttttctataccaacaaaagactttttaacactaaatatcccattccaggactgaaatgataatatggcattactgataataggatatattacaaatataacaagaagcgaaattgccggaagtaaaaacaccgcagcaatccagtagtcctttcttttcatacttttcctcctcatatgaatacattcagccaatgaagccggaatggatatcacaattcaaattctctatgaagaggacctccatttctgccatgcagccacacttttcatggaggcccttcctcttcttattcgtaatttgccaggttatccataatctctttacttacctcttcggctgatgaaccgcttcccaatagctggagggcatttcttaccactgtgagttccgccgtatttgtacttgcctgtgccagttccgcaacataggcctctgtttgggacatcaactcattacactcctcaaacatatagttatcaataatgccttctgatgggattacggaatatgtattcgcatactcttttaccaaaccatcaacaaactcctggcttgtcagccatttcaccacttttaaggaagccttaatctggtttactgatttattcattgtacagataaaatagttctgagaagcgcctcccatattggccgtttcatattgagcatcaaagtatggtatcttagtcgcatggattgtctgctttttaaagcactcggaatcagacagcaatgccccgcccctggataggtcgatcatgaatgcacagtcacctgcgccaaaataggaacgttctgcatttacgtcaacacttaaaacattttctccaaagtatcctttgtcctgcatatttttaatctcctgaatcaggctgacgatttcaggactttcatatgtaaactttctttctgccagctcattttcaaaatctggtccatatgactttaccgccattgcactcagaagatgcccataccggtaattatcagattcccctaccataaaaggctgatagccattgttcttcagcacttcacagcaattcacaagttcctcccagctcttggggacttccagattacatttatctaaatattcctcgttatagtataaaagaagttcaaatgctgaccatggcgcgccataaagaccttcatgcccatatcttccataatcgaccatattccaattcgcttttacaattccattgtaccaatccggatcagcttcaaaatatggctcaaggtttaatacaatgtcagattctacatagtccaggcagttggttcctccatactgcataaagatgtccggcgcgtctcctgatgcgagatctgttgaaagcctgtcgaggtagtcattttctttcataataaaaatcggctcgattgtaatgccattattggattcattccactcattcaccttatcaataaaatattcactctccgcatctccgccgtcagcattgatacgatgatataattttacagttgtttcttctacttccattgcatcaatatcataccctgcatccgcaatatctccctgcgctttttcctctttttttccgcttccgcatgcgcacagcccgactaatacggagactgacagaagacaagctataatacgtctcattctttttttcattctattctcctccttttcctttaaaaagtgcctttatacaaatcatctgtatgtcgctgtaaaccgttttccctactcttaaagcctctcctcccttctgttaaactctcacaaataagtctgccaaacgtttgaactgatagctcctgaacaccaatctgttatttgattgttgttagttgatacttgtattacaggtatgagtataacatacactatcatttttttcaatatatttattttatcaaatctatttttgggtatattgcacaatccatttttgttagtattcggtttctctttcagttgaaatattcataattcttttcaatgtgtgcattcatcatttttacagcctcttcctcattacggttttcaaatgcttttataatctgctgatgataataaataccgttctcaaaccccattttatcaattacagtatccattgactgctctaaaacatcctgcaaaatactatttgtttttatgaaaagcgcattccttgtaatctgggcgatcttaaagtggaactttagatctgccttgctaaaccctttgatatcagatttatctttgcaccccaccatttctgctagaataatctttagttcttcaatatcttttttcgttgcccggttcacggccagctttgtacagcctgtttcaatgatctgcctgaattcaaacacctgtgcatctgactggtctcctaaatacataacaggtatcaaagcattcatactatctccgatatccagattcctgacatatgaaccatcaccaagccttgtttcgatcaatcctaatgcattcagcttctgcaaagcctgccgtacagtaatcctgcttacttcaaacagctccgccaattcattttctgatggaattttgcttccaggcgcccactcgccatcaatcagcatcttctttaactgtaataatacttgttcacctacattaacccttttaatcggcttaatccccatcctgctacctcccatgatccatagtttttattcgtcatgcatattaataaatccagattggtgccgggattttaattaaatgcatttgatccttgtatgctgtaatacagctaacactattattaatgatttcagttcaattgtcaatcattggattcagttaataaaatattatagggctttaaaagtagtgatgatccatagaatgtcaaaaatatttactcttactaaaaaaaggatggcctcagctatccttttttaacagtttacgtttttattggcgacggttttagccccttattccggatcatcaaaacgggtttcaaatctccggtccgaccatcttacctttttgttgctcccggagtttcaagtttcttctccccaattacctcagctaataccagtaagttacttgtctccggccagcagcttccgttaaagacgcccccgatacacctttcgctttcccagtctgacatattgactcgctcacaaatatagccctgcggcagtttttccggctctgccttaactgaatcatcatctaacagggcggcatccttcggtacatcccacgaataaattggccgtttatctgtagacatatactggctaattgttaaggtgacgtctttggcaagctccaaatacatgggattttttgtccacttatacaccttaaataagctatcccctgataacgtacatattcctggggctgcatgtttattttgtacgttagcaaatacagcgcctaccgtcttcatatcctttctttcaaattcacagttttttggaaatttgtaattatatgagacaacccagctgctgcaaaaattcaccatatgctttgcatattccagccacttttcttcttgaatcacttcataaagaactacataactttccagcagcgcaaaagctgattcgctgtcaggacactggagtacttctcccggtcctcctgttgtaaagccttccattacaaatttatcccaatacatatccgcactttctctcgacactctcagatatctctcatcagaaaagaattgatatgcagatgccagcgcccctggaactaatgcgcctgcagtcgatccgcctactacaatgcagcccgaattacgattaataaactgcccaaattgtccatatgtatcccacatttttacaaatgcatctgctaattttttcgttccttccaaaaacggctctggaatcttaacattccgttccttcatcaaaccaaaatgcttaaatagaaaatataacgtatctgcgcttcttctaatcagatgccatttttcggatgcacttgttggattgctggcaggatttccagaagaatcacattcatccataaaaaaaccgctttccagctgtgttttaaaaatatgctctaatgtacatattcctcgtttccactccagcgcccctcccaatttcatcaatgcgtaggaagctgcccctccccctacccaaccaagctgccacatctgccctggttcttctactgttccaacgccgtaaaagccaccttccgccctccaattcattttattaaatttttctatttgtattttcacctgcttatcaaatggaagtgtctccggcctgtccgatggcaaccccatgcatttcctatttgtgaaaaagaactgaaaaaattcttgtatatctctacagggaaattcaaatattttatatggaatttctattttgcatcctttattaaaagcacgtccccgatcttcttccttcctcataaagggccatctataaatactatttcttctcatatgtggataagtaattccaatttgtccattttcataagataaaccaagattaattccatcaatctcttgtatcgtatatagaaaggccgccttcttttcctcatttgaatatactgctacacatggaacgctcacatctccagtagttatctcaattttcccttttccgtctttctttaaccgcggaacatcggtaattatattctctatgtttacatcagcctcttcttctgtaaacataggaggatagttctttttcatgactgaaaactgattccctttataacagcatgaaggaaaaagcacatattcattacctgtaattctcatatttacttgataagaaagttcaatatatgtatcttgaacatcagcgtttacttttatatacatcgtatcttttttttcacattgcattactgaaaaattatcattagattttagcagaagcatatctttcccctctttttgattttactattattctaattactcatggagcgctctataaatattttctcctttgcatttattttaaacgtttttatctcatactttccaaacaaaatttgttgtttaaatcctaaatatggaatttctattcttgtttccgccgcatggccgctggaattataaagtcttaacgtgtattcctcactttctgtttgtttataaaaagcccccagtataatttccctattttcaattataactgacggctgcacttcttttcctgctccagaagggaaaaaagaaacgacaaacggcggctgattgaatctcgctgcatcagagctaatatactttcgccgctctgtgcagcaccctggctgcacctcaaaatgaaaatgacgttccccttgatcaattcgggggatagctctgtcatctgtaagtaattcccttccttctatcggatgcgctgaatatgccgccgaatgaatcaatgacatccgcattctgccatctttatagtcacttccatatatgccatcattgatgatggtaaagcccatgtcatcctctacagaaaaaatcccattccagctttgagaaaccatctcacttccatctgctgtaagctctttaactccatatgcagtttcccccatacagatccccttcttcaaagtggttggtatttccatcttcaatacttttcccttttccccccattggacagccacatcgattccaatcttagaacctttctttggcaatttgtaatgcattgtcagatatgagctcccgtatcccattactgcctcaattactgtccgaacttttccgtcctcaatcacacggacatttgagattgttttttggattccagaatagagttttcccttttcatcttctaaaagaacaaatcttccttcttcttctccataacggtcggctctcattctccatgggtcattgtcaccttccagcacaattggacagaaagaattctcttttacaaattcttttccaaatactttcaaactgtctataagtcccgttttcgcattgacaattacttctaaatcctttgttatgaacttgtaatcttcttttataccaagactgaaatctggcttttcttttatattttccaatctgcagtcaaaacggttcatttgagacggcttcaattttgcataaaatgaaatcttcttgatccagtccaaattaatattacaggattctttttctacttgtgataacagttcccgttctccctgaaaaactctaggtataacataaaaatcatcccaattttgatcctgtagctgaaattcacattcaaatattccttctaattcatacggatgtggattgtaaattaaaatgggaatttccccttccttcgcagctgcctgccctgcagccagcttgaaaaaagcttttatttttaattttgacagtatttccagcccatggtccataagccgaagccccgcctcttcaaccgcaggaattgctgagcctggaagaatatcatgaaactgggctgtcaataagtcttcctgtgcagtatgtatatctattaatggatattccaaatccccgtgtaaacaagcatgggaaaacattctttcaaccatgaaaagttcattttccaatcgcctgtgcttttgttttatacgtatttgtgaagtataacaaccgatcgcccaactgtttaaatccttttccacaatcggatatatgttaccatcttttctcctttcgtcaaaaaattgttccggggtcgaatgttttactatacgttctctctgctcttccataactttttttaggccggccatatcaactctggatggtccgccgccatgattaccaacgccccacagcaaaagcccgttttcggtttcctcatgttcagtgatccattttcgcgccttttcctctgccttccccaacagggaattataatgttcactggagcggtgagccatgatttgagaatcatcaaatccgcaccaaataaaatcatcatttggaagaaaacagttgtcctgcagcggacgacaaaaaacataagaatcataaccactcttctttaaaatttgaaccagccctctgctgtgtccaaacggatcaaaatttatggccgtagtcggcttaaccccaaatttttcccaaaaatactttcgtccaacctgaatctgccgaatcaaggactcgccgcttggcatattacagtctggctgaagataccagcctcctatgatatgccacttccccgcctttacaagttgttgtatcttatggaaaagctcaggctcgtattcctctacccactggtataatattgcttcattatgattaaaaataaatccatcataatcctcacagaatttagccgctgtacgaaatgttgaaagcgctgccgcgattccatcttcccaattccataaccataccggatccaaatgagcattacaaattaaatgtagctgtttcataaatccacctgccttatctttttcttatcatttcattttttatacttggttattgtcagatgtcgacttgtaaaggactttatccaagtgcttccggatactcattgcacaataatctatatggttcttcatcttcttcaatgtctggaaatcgaccaatcggctcataaaatcggttgtcagatgtatcatcattacacatagagacttcgcccaataaaactgcacctgttcctttttcggcctcaaatgcatgatacaaaccttgatatatagtaatactcatgcctggagtcaatttgattctcgttcctgcgggtacataatattctcttccgtcactcaagacacggacatcatccgttcccaaaccctcttctggtgtagaattataaacgataataaaaacatttcccccgccccgattgatgatatgctccattttattccagtgaaaatgcatgggtgctttctgaccgtcttctaacatcagcagcttctcagcatatggtttcgtatacttctcgtctttctggttcccatttctcagtgtaatgagcgcaaaaccagtttccttaaaattatttaaaccaaaatcagtaatatcccatcccagcatattatccttaatttcctgatattctttcccctttgcattccattcactaacagaccaattgcaaaaagggggaagtttatatccttcctttttgatcaacctctccatattttttattattttattaatctctgatctcttcatttacgttttttccttacctgctttcaaatttcccaaactctgttaccagtctgtctactgttctgatccgctcaaatgttgtccctggcaccacttcatcagcaactcccaaaacaaatctgttatctttcctcatcaggtctaataccttctttacccactcttcaaaatcagtatctgaaaagctatctgcaaaaaaaccactgggcagtccgccccatattatggtttcctcctttacatgtttccttaattcctccagcttaatatctcctacatgataaggtgtgactgcttcaatgacatcaaatcctgcatatgaaagtttggtcaatagcgggatcagtgttccatccaaatgcaccattgatttttttcccgcctttctaattcgttccgtccaatcctcgtggataggtttaatgtactcatcgtaaatatttcccccaaccaattcactgctcagattatcaggcacaaaaatacaccctgcgggtgaatcaattgcaatctgtgctgcctgcgtgtgcttctccgccatacacttcatcaattcatcgaattcgttcggttcttcttgcaataactctgtaataaccgtctcaatccctgcctttaaagccacaagttccatcataggagatttgggcgtataagatacattaataccattttcaccgatagacttcatccgcatttcagataaagcataatccggcacatactcaatatcctggtacaaatattgtaaggctttcaaatccttgctgctttttaccagatattctacgggggctgagctgtgggaactctctacatatctccacacctcccgcaaagttccataaggcgttttataataagtgattgtatcgttcttattcttagtaatttctacactggcattatgatagatctcctgaaacggaaaatatccctgcagatagaagcctgcccccaagtccttatgcaattgctgcaggccttcttctgccaatcctccggcaagtccatcgactagatttcgggtataattgctccccatggctaaatattctttaggtatcttctgttcatctcttaaataatttagccaatatgccagatctgcaaaccatggaacgaattcaggttccttaccttccagaactttgagcacatcacttcttttactcatatgtaaattctccttattgtcttattttcaacaaatgcgcactcatagatcaagatataatattgtgtctgccagaaccttccattatctttttatttagagaatcgtatgctgcatatgcttccagcacattttccggatttgcgcctggtccaaactcaagctgcataatccagcccccatttttccacaaacacagatatacctgttctactgctttcctcacttcttctgctgtaccgttaaccaggatgtgctgtctgtcaatttctccccaaaaacatatcctgcctgcgtatttcctcagattttctaagcccatacaaaaaatctgacagtttaataagtcgattcctatttcgattaggtcttcaaggatcagcaagatattaccatccgaatgcatcaaaactttttttccataccgctttgcaatttggacatagtctttatacattggtttgaatactttccgccatatctgaggattgataagcagtgattcctgtgatccccaatcatccattaacataactgcatctatatcggtctgacaccatttttcaagtaatctgcaataaaaatcatgcattttggtaacaaaagacaacattttttccggcataaacatcaagtccatgtataataactctgttcctctaatgaactgaagctgttcaaatggacgcacaacacaatctgctcttataaatcgatcttcattctctttacaccatctatttactgtttctatatcaaagctcaaaagttcttccggaatatggattttagatgtatcttcccattcatcatccgttaaatctattaacggccttttcacctctccaataactcccggttggatattttcaaagatgcatccccattcgtccatatactcgccatatgtaaaagggttaccactggctattgttttttccgtatatccacactccattacatttgtaatcaacgcatacttttgttttagttgctttactagatcaggaaatctgtcttccgcccatggcagtgtccatatatcgctcggtatctgtattggatttttaaattctaatgccgagtaaatagcattctttctgtttacccctaagtatttaaaggcatcggcagtatcttttaaatatttgtcagttatacctatactacggggctgcgggtatgcttttgcaataaatccgccgttttgtgttgaaaataaccggatcatttgttccgctttttgaaacagttcttctctgtttaaacttaaagttctctgtatatctaatgggcagaaaaagcatatgcgccccttataacgtctggaaatttcctctatccccatgttatcctgctgatccaaattaattacatcacagcctgcctgtatgaattcttctataaggtctaaggtatacccacagctgtggataaatgtatccataccataatcgtgaatatgttgatacatttttttaaaccggggtataaaaatctctctgaatttttctatagaaatcattagccgatcctgcagagccgtgtcatcaatagttattatcccatcaactcccaacgccgccattttatctatcacttccaggtttatctccagaagctggtctaccgccttttctattatttcttgattaactgcagtatttaccaagaaatcttcaaaaccaaataaatcaattaagtgttggaaaagcccgcaagggagcattcccaatacatatttctcctttacattattccggatctggtcttccattcttttatatcgccaatcttgattaaatttgggaaatttatatgcttttaagtcgtctgagttcccgcactcttttaatggaaaatacttaggctctccaaaagactcgtccacgctcttataaatgaccccccattcgttttttccatctatcggaggcttggactccacaaatacccacatcatatcttccccataatattttccatcctggggagttctattagagtcgaaattatatggaattctttctggggttttaaaatgaatggctgctttaactaattctctgctcgtcattttctaatcctcttttctagaaaatatggtaattttcattattcaatacaattcaataattgaatgattttagagtccctgtctttcaagagtgcatgatccatttttttatcatattcgtatatgccttttccactcattatcccaatattgccgtcctccacacacttttcaaataagtgattgatgttgttattattacataattcaggatacaggtactttgcaacactattaaaaattgtaagccctcccaaatctgcaatttgaaagggacctgagcatacatagcgcagcccatttccatacttgattgtccggtctatatcctccggagatgcgattccttcttccaccagataagtagcttctcttaataatgcaaactgcaggcgatttgataaaaaccctttaatatcatgttttactaaaacaggttttttccctaattgtctgaaaaaatcaacaagcctttcacatacactaccgtccgtagattgcccttttattacctccaccaaggggataatgtgcggagggttcaaaaaatgtgttccgcagaaacgttttttattagtcacataattacttaaaagatctattgaaattgcggaagtattcgttgctataatggtatcctctttcgcgcttctgcatatctcttcataaaaattggcttttatattaatattttcaggaattgcttcaataattaagtcagcatctttcatacattgtatatctgttgtaaatttaatagacctttgtattgcctccgcctggttggcatctatgaccctattttccactaaaaaatccagattattttttaatacttcttttgcgaacacaaaatcgctttctttaatactatataatgttgtcttaattcctactcccggaaacatctggctgatcccagcccccataagccctgcacccgcaacaacaacgtccttgatatccgatttttccatatgtatcaccttttaaaatataaaatattttatattactttaaaatgttttcactggcttttatcattgcccacacgttttcagtaggaatgctgtcgatcattgtattgcatgtagacagaataaagccgccatttttattggctgccagtatcgttttcctgactgactccgccacctcctgcggtgtgccaaaacacatgatctgatctaaatcaatatttccccacaaacagagcttatggccatatttgttttttatatctgcaatatccataccggctgatggctgaagtgattgtattccatcgaatccgcacgcagttatatcctccataactgtattgatattaccgtccgtatgcagaaatactggtatttccttataactcttaatttctttcagcatcttcctatacagagggaatacaatttttcccatgatatgcggcggcaaaaatactccagtattaaaagctatatcatctgctatcaggattccatgggctcccttatctataaatatttttgccttttctatttcatattcaatcaccttttcagatatctctagcacttcctccgtgttagtcaggcagtataccatgtaatcttccatcgtatacatttcatctaccatagagacgggtccgcctatctgggcaaacacaaaaaattcagtttcttttacataccgttctactaattgccctgttacgaattgacagtcgggctttctgtaattttctgcatcttctatatctattgcctcttgaactatatgttttgttttatcggttatttcataaatttgcccatatatactttgaacaagtttatgtccattttccgaaactcctatctgccattccggccattctcccacattcacgagatccatattcaatttctttcttatcgcaacatctctgtcaaaatcctgatagttcaaagaataagtccttcctaaaatcctatttgccaattccggttgaatatagacttctccttttggtacacggtctgcttctttgtgtaatatggcattctgtactctttctctgctcttcattgctgccacccctttttactattcctttactgcccctgcagtaatgccttccacaacaaatttttgcattaccgcaaatagaattcctgtaggcagcaatgctattacaccgcctgccattaagacgccccattcaatattattttttcctattaaggcttttaacgcaaccggtattgtccagttctccgctgtacttacaaagatggttgctccaatgagttcattccatcctcccaaaaagccaaatacaaacactgatgcaataccagggagcatgatcggcaaaacaatttttataatcgtctggattttcccgcatccatctaccattgcagcttcctccagcgagtccgggatccgttgaaaaaagcttctcattgttatactgcaaaagggtagatttccgcatatataataaactaataggctaaacttcgtgttaatcaagcccgcttctgcgaaaaaagaatacagtggaatcagtaccaagattccaggaataacctgaataacaaggaaaaaaagcagaattaaccctttgcctttaaatttatatctggacagtgcatagccacttaaaattgacagaattgtaacaacaagtgctgtcagcaatgctacaatagtgctgtttttaatataaactccataatccatcatcctgaacaatgtactataattctccgtcgtaaaagtatgtggaaaatatgtaataacacttctgtccagaatctcggcacttggtttaaatgaagtaattacaacccaatatattggaaagacaactatcagaaaataaaaagtaagtacgattgccttaaacgaaaacagaaatttctttttacctctcataaattctctcctcccttctttctttttgatatcgctaatccggaaattgccaataaagaaataattaacataaatgcaacccctagtgcagaagcaaatccaaagtcgtattttgcaaatgctcttgagtacatataagaagtaatcgtattcgaagtatttgctggtcctcctcctgtgataatcatgatcagatcaaaggaatttaatgaccaaattgctctcagtgaaaccgttgtaacgatcgtaggtttaagatatggtaatgtaatagaccaaaactgacgtaccagcccgcatccatctattgcagatgcctcgtaaacatcatttggtatcgattgaagcgctgctaacaacagcattgcaaaaaaaggaaatccaatccaaatagttgctataattacaacagccaatgaccatcctggcgttcccagccatgctattttttcatttatcgcccctattttcaagagaagatcattcaccactccatattctccattaaatgaccacctgaacatcaaaccgataacacacccggaaaaagcccatggcagaaaaacaattccctgatataagcccctgcccctaaattttttccgcagggtcaatgctaaaccgagccccagtataaactgtccgataatggaagtcagtaaatatactacagtattagtaaacactaatttagtatctttttctgataatagtttgacaaaattatcgagtccattgaaagttatattatttggatccgttagtttataattttgaaaagccattataaagctgttgattaatggatatccaaatactaagaccaggctaattataaccggcagcataaataagtaagcctgctttgtccttgttctgctccgtccttttgtttctttaaatatacaataaaatattccagccgttactattataaaaataataaaaaatagaattgtactcacatttttcataggttatctccttaaattgcttcaaaagcctgccgtaagtcttcctgtaggttttcagtaccttccagcccgcagtgtattctgatcaagcctcgttctttttctgttaatcccataaactgcaggtcttcagaagcaatattttttacaggacataaggccagactttcaaatcctccccaggaacatccctttccaaataatttcaaatggtctataaattccacggctttggatgcgttctcttttaataaaaagctcatcagtcctgtatgccctgtcatctgtttctgaataatttcatgctgggggtgggaagcaagccctgtataatataccttctctactttaggatgattttctaaatattgtgcaactgccatagctgtttcctgatgctgtttcactctcaggggaagtgtacgcagtccccgtatcgccagccacgcttccatcgggcctaaaatagatgcaaaatattcccggtaatgcagctgcacattatccattagttcagcatcctttgataccaataccccaccattgatatcactgtggcccccgatatatttcgatattgaatgcatcacaatatctattcccaggtctaatggctttgaaaaaatgggtgtacaaaatgtattatctatatatgtttttataccatgttttttggctatgcctgctattgctgctacatctaccactttaaaaataaacgttgcagggctttctaatataatcagactggtgttcatttttatagcattttccagttctctgatatcatcgccggcaacatatgtaacctccattcccagcctttccacgcaatattcatctaataaacgcttaaccggaaaatatacatttctcatgcagatgatatgatcccctgtctttgcgatcgaaaagacagcggcggttgcggctcccataccactggagaaggcaactgcttttttcccatgctcaagcgctgctattttcttttccaagatagttgttgttgggtttgccgttctcccataaacaaaatcctctttcagattaaccgtactctgtttttcataagtatcaaaaacatgcagcgagttcataaatactggcggtactacagcgttcatatatttatccggattttcacctaaatgagttactgtaagtaaatcttgattcataactttatccattcctttcactgttctatttttccaaatagccgattatatgctgttaacacagcatcctgccttccgccctgtaaattgcttgatatgtatataattgtaggatattccggcttccaacaagtttttatcttttcaagaaattctatttctgttccaatttgtggattatctccgtgctgatagtgcggcagtattactgctttcccaccaaaatagtcatatatactgctcatatccgatgaatactgtgatgcaaaattaacggatctgagactttcattttttattattttcccaaagtacctttcattcatggtacagctatgcagcatcaagcctccaaattcacggctaataatattgttatattttactccaaattcctcatacatttcgggtgaaaccatagacattgtatcatcagctatataaatgcctttttccttaggcgcccaaataagaggccatgttagcggacataaattatcacatactgctttcattgcgtcgatatattcgattactgtttcacacaatagttccagtaattggtggactttcccaggatgttcgtataatgatatataaaagtcattcgtctcccatatcatttccgctaatcccaatggattttgaatatctcctactcttattggtattttgccgtttgtcttatttgcaaaatattctatcagccggatctgttttcctaaaagtccatccaaaatgttcggcttttttatgttgtctacatcatctaccgaataaataataggattttccaagtatttatgcccatcttgaaaaacccgttcctttccgcctaacgcacatggaatgatatgtgtcccaatccccgttaccagtgaattataattatcatctctcccttgcagcgttgtattatatctatgtatagcaatttggtaacatctttccatatcatctgcgttccctgctatttgtaatggagcatcttccgtctcctctaatattaatgccggtctctctgcttttcctaaattccatattacttgcagcagttctttacctctcaatttttcactcctttaatgatttagcaataggcaacattacgttgcccattgcttctaaatatctgcctgtctataaaatgcgtttcacatttattgaattacaataggttccggaactttagatccaggattttcttctaagtgtttcttcatacggctggatagctcatttgaaaggatatccaatgtctcctgctctgtctgctctcctaaaaggcatttctgcatttcgacgtgtaatgtttcttgatgaaggtctgttacatcaaaaggcccgtagtttgttgggaatattgcgtcctgctgatttaactgtgcaacaaatggagcatatataccatcctcaccataattttcatcatctccaacatcagctttaacaggaattgcccctgtctgtaaacaatactgcatgttattatctgtacgtgataagaaatcaattaattctattgctgcttccttgttcttagtctgggatgaaacgacatatgagtacggattagaagttcttataatccgggttccgtccttgcagactggtacgggaagcacgccccattcatcgtctgacattttttgggataatgttaatgctacttctgaatcgttccataatgtccctgtcaagccacttgcaaaattatctaccatttcggcaaatccccagttcacagaatcttctggaacatagccatccctatatatatcacaccatttagcaaacgcatccacgcactcagggctgttcaataagcaattgccctcttcatcatacattttacctatagtaattccttgtaaatatccctggacacaatcaaatccgcctcttgcccctctaaaagaattgccgtatcgattcttctctttatctgttaatgctttgatcagctctaaatatgcatcccatgtccaatcatcccctgtcgggatctcataaccgatttctttcgcccagtcttttctatagtagatccccgatacctgaaatgcatccggtactgcatatacatgaccgtaaagctggcgttgttgttcccatgtatatccctttaccacctcattatattcatcctcatgttcttcaacatactcgtccagcggataaagccattccgcttcagtaaattgtccaaaccagctttctgtaaaagtcaatacgtccggcaattgtccggccgtaccaagaaccgtcagcttatttgccgcatcatcccacggaacgctttcataaataacctctatccctgtctcctcctgaaacttctggaatgtgtccttataataattttcccttgcttcactaggcgacacatccataaaacgtattgaagtactctcctcagtatcagctttcacatcttcttgtttttttccaccacatccgcccatcattcccatgactgatgcagttaccatgacaactgatacacctcttcttaatattttctttttcatcattttctcctttctttttttgaggtttattgctaaagaaattctatcatacgaaacagatactatagaatagatgtatttattattatttgtatatttcgacatataaaaacacaagtactctttattcttgttattaataaaagagtccttgtgtttttttcactttttattaacttttttaccttgaccgaaactcacttggatttattcccgtatatttaataaatactgtagtaaaatatgcaggatcctcaataccgaccgcttctgccacttcatatatcttcattgtagtatccttcaggaacgtttttgctttctctacccgatatctgttaattgtttctattatagtctttcctgttttttgtttatatattcgactaatatatccagaactcacctccaggtcatttgccatttctgctatagtaaagctatttttataattttccgcaatatacttatctattaattttactaaataatgtttttcatgtttacttttcatgacattatcgacatatatcatcattttctctactccatcatatacctgatatgcagtagtagcccgctctatagctaagaatgtctgttgttcattttcctctgtatcctcatcataataatttgaattcaggtgtctatatgctatagatataaaattgaaaacacttatttttaatttgtcaataggatactgtatttgtgaaagttgttctgcagtcgcttttagaagttgaattgcataagggaggtttccttcaattaagcaagtccacatttcatgaaatctttttttgcagtttatttctatagaatttatttcagatatatagccaatgacttcattctcacctgtccaggcctgatttctagcagtcattgcctgtccccaggccagtgaaagtaaatccagagcataaacaacatcactgacacctatcttaatgatcattctcatgaattcttccgccatcctaagcgtttggttgcatatacttaggattccctcttttgttacttcttttttgttgtttccacaaaatacaattgcaatttccttttcttgtatttctataaaataatactcctcctctatgtccaacgctttgaacaaattcttaatcatcataagaatgttgtccttagaatattttttttcattgtaaatagctattaaagaacaaacacagtagtttttctcttccctttttagggattccagctctttttcaagctgtggtgcacagttattacctttgatcagcattctaagcagcatttcctttaggtaactgtctttttcttctttttcctttcggcttttattttcttcttctttttgttcaatcaatcttttcattgtttgtggtaattcttcgataaaatcattttttataataaaatcagatgcccctttgcgtattgatctctgaattagttcgaattctgaatatgcagtcagaatcactacttttattccttcatataaatctgtgatcttttttgccaattccagtccatccataaccggcatttttatatccgtaattacaaaatccacatcattgccttgaataaactccaaagcttctctgccatttttacatgtcttggaaatcgtacaatttaattcattccaatcaattaacgttttaacgccttgctgaattatgctttcatcatccacaataattaccttgtacactactatatccccctctaatattttggcagttcaaaccaaataattgtcccttctcctattttactttcaatatgtaattcactgttatacagtagctgtaatcttgtaccggtattccgcaatcctatcttttctctttttaaactatgacaatcatctgtatggagagattccacatcaaatccgattccattatcacaaacttctattcgtatcgcatgttccgcctcttctacttttatcttaatctccatactcctgttaagattattcataccgtggatcactgaattttcaactaacggttcaatcgtaagacgtggcaactcatattttcccaagtgttccggcagtgaaatcgagtattgaagctgctcttcaaagcgttgtttttgtaaatacagataaaactcggtatattccaattcttttccgattggaattctcgcatttttttctgaatatagagatgcacgtaaaaagcctgaaagtgctttcaacatatgatatattgtatcatcctggagcattttcgcttttatctgtattatcgtcaatatattgaagagaaagtgtgggtttacttgctgttgtatcatttccagctctaattcctggtacaatatcttagatttatactcttcattaatgagtttttccattttcatagtcatattattaaatgtttcactcaaatcattttctgccttatttgaatatggtttcagccttattgcataattctcgtctttaatagcctccattgcatcatccagatcttttataaactgtgtatttctcttagacatgcaaaacactacgattattgatattaaaaataccagacatatcatatataatataatagttagctctttcagcaccattttatttatactattcttagggataacatttaccaggcttaggttcactgttttgatatttttagtaatacattcgtattcaactcctttatagaaaaatatactttcatttacgtctttatattttgcaacttgttttataaattcgtcgtcttgcatatcacgggaatacaaatttttattatcttcgtccaaaataagtgttagcattgtatcatattcaattttgccttcatacgtattttctatcgcatcattattaatccctaataaaataattaaattactctcccgctcctttggtgctgctattttgagagcagcatacatcgtgtcgtccttaggaactggtgatagaaaataatacaatcccgtattatatatattgttgatttgttcactatcgtatacttcttgtaaatgcctctctataataatgtcttttttaggaaccgtatatgtatataacaataacttatcattttcaaatacagaaatgtatgctatccccctattattccaagctgagctatagttaaaaacctttttaagttcctctttatatctgttccgattaaaaacatagttttcatttttttcttcaaaataagaagggtccttacaccattcaagaacactcgtttctgttgctgctaaaactattgtatttgatacaaactcaaatgcttcttctaaattacgtgccgtttcatttgtatacgcatttattttttcaatatttattttatagacccggttatattcgttagcaatgatggaaattcccaatagaactataatacaagatagtaaaaaaatcatattttgttgaatcgtacgttttccatcttttttcttattcatagctcacctatttatattttccaatacacaattttctattacataatataattctagcataaataccttttaatgtacctacaaaatttttgatattttgttattattttcgattccgtttcaaaaaaatttcataagtgccattagcggtatctttcaataggcagacggcgttaatatactcgcctgcaggatatgaacagtaacgcttttgatccaactttgatctaaaaatcctaacttaaaaagggtacttgaaaaaatcaagtaccctatggattatatcattcctttttctgcctgcgaaacatcatctccggtattaccaggcagatccccgccaatccggcaaccagtacaattgaccatcccaccggatatctggacacataataggaaagcctttgctccatatagatacaaatcagcttcaagatcccgcttcccaccgtcaacatcaaacctgccgcaatcaggcagtaatacagcccctccgccgccagcatccttcgctcctgccgccgggtcatccccacattcttcataacctccagttctcttttcctggacaatattccggtgatcataacattaaaatagttcgtcagccctgcaaataataagactgcgctgatgcttccaagaatcagccggttccctctgatataattggccgcctctgccagcaggtccgatttgctgatacagaagattcctgcctctccgttctcctcgtctgctcctgttcctgtcatcttttcccgcctccggttctcccgggatatcatattttgaatctctgtctttatttttgtctcccttttttcatccacattcaattccatataaagcgtttttttctccgtaggcagcttatcaaagccctccctgctgatcagataataaaccagcccctctgccccatgccaggtctgacgtatatcaggaaatccctccgcccggttatccagatagccgcttaaagtgaacatatccgactgtattcctccaagtgcctcttcttctattacgctgtctttctcctttggactcagctgatcccaaatcatccaatctttcttagaccgcattgttgtaaaatacagcggttctcccacactctcctttgccagcctctcctgttttggtgaaagctgatggtcatggagaatcatcacgcctgttccattttccagactgtccatatccaccggcagttgattgtcctccacatactgccgcagagcggtgatctccccgtcattcagaatctggacgacatcttcaagcccgccttcaatcatggcatagttttcaccatatccggcgccttctattaccggtgcgtttttattaaatgaatctcttttatccagtaagggcatcactccttttctggaaatagtcgaagtcatataagccccctccatgatgtacgacttctcttgatccaccccgtcaaggcttaacaaggcttctctgacctctgaagaaataggggaaaactcatcataggaattgccatataataagtataaaatatccccttctgtcagcatcggatcttcacccacatctctcgatttatactccagtccgtatccctgttccttcccccactcactgaattcaccggcaatcagaaaatccggacgctgctcgatcacatgtatataatcactgcccttagtaataacaacagcccccagaaaggtctccatcccaagaaacagggaaaacaccgtcagtaaaaatcttccccgatgtctggtcaaattctgccatgccatgtaccacagttccccggcagcgcttctttttcgcctcttatgttttattcgtaccagtttcttttctgtctttctccattttgccttcttttgcctgtttcttaccagaccggtataattcatactctccacacaggatatatttacgatgtggtgaatgacacctgccgctgcgcttacggtgagcatcactgtaaatacgatggaagccgccagaagccccggccgaaagatctgcagttctttcgcgcctccatatccgcttaagtattgattccccagtatctccgatatcactgccagcaaaacaaaggccgacagaagtgtccctgccagcacccctggaattaagattctaagaatctgtcccaaataaattctatgcatctgttttttcgttgtcccaaccgtatttaaaagccccatctggcggatgtctcctgccatagagatctgcatcacattttgaaccagaaaaaacataccgcacaggatgagaagcgcaccaaatgcggccatgccataccctcctgccagccgattgactgcatcgtaggcataagtattggcagcagtaatcttcgcttcagacgcctttcctgatacatcctgatataaacgctcttccgtctcttgccagtccatatgatctgactgacagatcaaaatatctgcttcttcccagacatgatacccccaatcctccactttctgctctgatatatatcccactgcagaattggacgtctcacccacatagtctgtataccagccgctgaggcggaattcttcctgtttcgtacaaagcagtccgagacttaccgtaaggccgatccgcatccccttctccggatgatcaatacccagacttttcagcgacctggcagaaagcatgatctcctgcttttcctttggatagtgtccgtgaatattcgtataagccggtttcctaatctcctcccacgccgcatcatccagcgcctggatcttgcagatatactgatcaccgtcggccgcctctcccagagttacacaccttcctgcccgcttcacataactgagggaacaaaccttctcatactgagactggtccgcatccccgatgcagactgatgctgcggttcctgccgcccttaccgcctttgtatattctgcctgaacctttccgaatgagattccaaataccatggtcagcgtaacaatacacaaaataaccgttcccaggagaatccggtttctgcccttattgcatttgccaatctcccttgaaagcattttaactacctgtttgttttgattcgaggtaaatccttttcctgccataacttacccctcctgcccactgcttgtgtcgctgttctgtatacatttcccacagtctgtcctgctgcagattctgccgtcctccatccggatgacacggtctgccatctgcgccacttcctcctgatgggtcactacgattatcgtctgatggtatttttccgcacaggattttaaaagccccaccacctcagtacttgtggcggaatccaaattaccggtaggttcatcggccagcaggatagccggcttggccagaagcgcccgggcgattgccactctctgctgctggccgccggacagggtctggggcagccgctctaatttctcatggattccaagaagttttgttacctcttccagcaattcgcaatcaatctctgctccatccagccgtaacgggagcacaatattttcatagacactgagtactggcaccaaattatactgctgaaagacaaatccaatattccttctgcgaaataccgtccgctcctcaatctccatatccttcaggctgttcccgcgaatccagacaccgccctccgtagggatatccaagcctccaagcatattcaggagcgttgtttttccgcttcccgaggttccgacaattgccacaaattcaccgtctctcaccgaaagagtcaccccgtccagtgcgtggacctcataagtatctgtgatataatattttttcagactggcggccttcacgatttccataaattcttttctcctgctctgtatttggcagcttacatatcatagccacagaagcctgattcagttttctgccatacgactagtatacggagtaaatctaacaaacttctaacaatgtggaaggaaaacaaagttcaagcatcagccccggatgcattctcttcgccaccagaaatcctccgtgtctgttcacgatctcccgcgacagataaaggccaatcccgaatccttcctgggtggtaataccttgtccacggtaaaatctttggaaaatctgattctcttcccctgccccgatgccgattccataatctcttacccggatcttcaggtacatctcattttgtgacatggatacttccaccctgcctccggcttcactgtacttcacagcattttccagaatatttaagactgcctctcccagccagttaggatcatgcaggaaagctgcattttccaggagagagatgtcaaactgaatcccctttgtttctgcctgtggttgaatctgtccaagggaattccggagcgttttcagtatatccttttcttctttcttaatctggatgatatgctgctccagcctggacattttgataaaactttctacaagaaaatgtaatttttgctcgctattctcaatcgcagccgcatactgcagagactgcccggcaagattttcctgcaggaacccaagatatgtctccatgttcatcaaaggcgtccgcatctgatgcgcaatttccgcgatcagtttctgtatctcatcgcggctcctttccgctgcatcttttctcccctgcatcagttcctggacccgcaccagctgatgttcaatccttgcgtacaaagtctcttctcccgaagcagaggcttttatttcccgttcattcagaatctcatgggtcagctctattatcttattcagttcctgctccctctgttttctctgcaggcaatacataccgatgctgccaaacaatccccctgccagaacggatatggtcatgataaaatacatactatctgcctccgatccgataccccagcccaaatacattatgaatatactccggctgttttgcatccggttctatcttttttctaagccggttaattgtgacactgaccgtattatccaccacaaactggccatccagaccccagatctgctccaggatattttcttttgtcagcacctggccctgattcctcatcagatactccaacagctgatactccttcgcggtcagcgcgatctcctgttcctttaagaagacttgttttctgtctggatacagcgctatatcccggcaggaaagcatctgctcttcgctgctgcgtttgaataccgcgttgattcttttcaatagcactttcatagaaaatggtttcaccacataatcatccgcacccatgtcaaacgcggccagcatgtcctgctcttcatcccttgccgtcagaaaaatggcgggaatgtcccgtttttttcggaggtcctgatacagtgcgattccatccccgtccgggagtccgatatccactaatagcaggccctccttcttccccagcagggacagggcctccttctttgtatgtgcacatatggtatgaaagcctgcatgttgcagggcaatatccaaagcctgattcaataatagatcgtcttctataattccaattgtcattgcacttctcctaatgatttcttttcgtaatggttcaggcatgcctgaactgttactctttttcatttattctaccatgaatggcaataaaatgcggagcagtttcctgctccgtgcttattttacttatagtacccataacgccgtaccgcctcatgcatcgcagacagattttccggcggtgtccccggagacaggttgtttgcctccttgatgataaacttccgcgtgaagggtttgacagcttctaaaatagttttcaccgcattggcgacttcctccgccgtgccggcacgcagcgtctcgacatggacaccacctttaaccgtgatatcaggtcccagctcgcgaactaccctgccatggtcaatggggaagcccgtatcgaaagtaccggcgttcagttccctcaccagtgtggggaagaaccgggaagcgtccccgcagagatggatccagcccggctcctcccctgtacacagttcacgcatcatctttttgtggaaaggcagtatcagctctgtataggtatccagggacagcaatgcaatgctgtcgtcggcaaacccaaaggattttgatttttccggctggccatagcagcggcgcagggccttattcctcgcaataaccgcctccgtaatataatccagcagctccatcatataatcctgatccacatagagatccatacaggcctgcgtagcgccgatcaggctgcacgcgatggtaaagggtccatctgttcccatccccgccatccccgggctgcccaggggctttcctttgtacgtgtatccttcctcccgcttctttttaaaaaactcatagtgggacaaaagtgtacttacaattccgccgagaggatccgtcaggggacgcgtattttttaaaagttcatatttcgtcgtttcatccgcgcatacttttgtgcctggttcattgcacccatggaatgcaatctcacagcccagacaggccccttccagaacattttgaaaatccgggtacggtgttatctcctgcagattctcaaagcccatgatgcggtcgcttatgagtgattccgcacagtattcctggaactggcattgaatctccagcatgatctgtggattctttaagtattcctcaaacgtaatccggcgcgggtttagcattggatccgagatgatcatccgtggattcatcgcaagctccatcattacacgctcacatttgccttcttccgcctgctgcaaaagtctgcggacttcctcattatgcttttcatagttcatgttaacacgctccttctctacactgtatactaacagtttatacaggaatccacagcgcgtcttccaagatatgatcatcctttgattctgtacattttttcggccaaattgacatttcttttatcccatgatacagtaaaacggtatcccaaaggcatggaaaacaggatgtcctttgggtaaagctgatcaaaatatctgctgccgcaggctttgccgagtaaataaaccattttatacgtctttccagaatctgtcaggaggtaatccagatgaactcccagaatgttcgaataaccacagatttttccgggttggatattcccaaccttcacctgatgtcccgcgtcgaataccggggatctgacaacgctccgctgaagccgcacctgcataaggattgttttgagctgtgctaccacttcgaaggccggcagcactatgaactggggggccgcctgtatgatgtgcacagcggcgatatctttatagccatgccgaacgaactgcacagtaccggcttatggacagaagaaaaatcaaaattttactatctcatcttttcctgtatgcctgacacccgaaatttccttggtctggacgacgctgcatccgattgtatccgcgacacgctttattcaatccagacacggttattccggggaattcccattttgaagaagctgatggatgaactcctatccatcagtacgactccttctccattttgccgggcacggacggtcagtctcctgactgagcttttttatcacttatccaggttattgcagacagagaataccggaaccgatacgatcccagaggatatccggactattatcgactatatgggcgcacatcttgccgaaagctgccgttcggaattcctggccggtctgatccatctctcaccgccccagtttcagcggaaattccggaggagtaccggcttttcaccttatgactatttacagcgcctaagaattgataaagcccaggaactgcttgccggttctgaaatgtcagttaccgatatttcgcactccctcggcttttcttccagccagcactttgccggtgtattcaaacagtatacggggcagactccatccgcgtttcgtcggaaattaagatagctgattccccctgaattgagcgggaattactattatctatatagtcgattttccaactgccgatcagcttcccgaaaaaattaaattcttcaggcagcgccgcatttttactttcgcttgtcaatgttttgagaaagttttgcattcgttatttcctccgttaatcctaataagatctgctacaaattccgcttaagttcgtccacaacggtattctccactttcatgctttcctgacactcactgcattctctgtcatggacagaaataataccgccgcattttggacacgtatatttccgtttctgcatttccataaacctttccaacccgtgttgacgaacaacttcactattctccataaggctcgcctgataccttttgttgtagcttttttcaaggtttttgatgggcttacagggatattcggaacatgcaaaacaataagacagccctttcgccttggcacaatcttttatcttgcatttgcggcagtgttcaggcttccccgtatcgctgtttaaacaacccgcgcaaggctttttatgataacaatgcttataacaaaccatacagttcataccacagggagcaaacatacccttattaatgttttctgttggcattttcatcacacacaccctcgtctacctttattctttctggtttcaactttatcacatttccacccttttaaatagaaaaaccacccttgaaactttggctaggtgtcagggtggtattttctacttctttcacaggtcgaaccactcgtgggcggttgttcccttttctgtatagatcataacagattccagacatttattcaagatttcttacaacatgtttgcagtcttgcggacagatagggactacacagcaccgtaaagggacaaaacttttcctaacatttattttctaagcaaggaaacagcagcactaaccggaactgcttttcatcttcttgaacaatagattttccacccattttctgcatcatattatttatattctgtattccaatcccagtgctttccggctttttttctgacctctgaatactgtttttgacagaaaaaccgaccatatgctcttcctgaacggaagaaatctccaccggtgctgacgggtcggcatacttcacaatattagaagtcacattgtctaaaatccgcatcacataatcggttgaaatctgtataacacagtccacccagtccacatgaaatacaaccagaaaacctttctgctcaagaaagctgcatatttctgaaaacaaatcgtaaaacaaaacttcatactgctctggttcttccagctctatctcgcccccgcctgcaatcagagaatattcaaaaaggtggtctgtcaactgtttcatgcgatgagctttcaggtcaatcttatccagatactctttaaactgtacctcactcttatactttcccttcttcaagatttccgtataaagcatgatagaggttactggtgtccgcaggtcatgggacatctccgtaacaatcctctgattttctcttaccatctcggcttcctgctgtatcaggctgacaaaagaaagccgcatgctgtccagtccttctgccagttcagataattcatcttttccctttaccgtaatcttataatccaaactaccactctctaaaatttcaatctcatctcttagttttcgaatataatccattttccgacgaatgcctaaaaggacaagcagaagaaacaggacaaaagaaagtattatctcacctatcataacataattataaaactgatagatatatgcgcctgttatgatgacttccaccgcaccatctgaaaattctaccatataggagctctcccattcatagttttcagctgcaatctcttcctcccatatttcctgccccggatattgtgaattgaatacctgtattttatctttatacatacggatgaacaataactgctgcttttttacccactcattcaacttactggtatctctggttgagagattttgctgctcaacatattcctgaagttttaccacatatctttgattcttcttttcaacgtaatttgtcccttccacataatagtcagttaagtattgccccgcaatatccagaacacaaaacatggccagcgctgcaactgctgatacaatcaaaagacgcagtaactgtgtataaatggaatttcttctactcgtttcccgcgtcaaacttatacccctttccccatatggttttgatgtacttcgggtgtttcggatctttctctatttttacccggagtttccggatatgcaccattaccgtgctgttacaggaataaaaatacggttcttcccacacactttcatagaggttctgtgccgaaaatatttttctcggatgctgcatcattaacaaaagcatgtggtattcaatatccgacatttctttttccataccatcgacatacacttcattaaaagtttcatgtatcttaatacctccattttctaaatatggctcttctttacccatttccggcacatttcttcccatatagacgttgtaccggcgcagcaatgcctttacccttcccagaagctccgcataagagaaaggtttcggcagataatcatccccccctgccatcaatcctattaacttatctgactcctgtgcttttgcggtaagaaagagtaccggaacattagaaaccttcctgatttcttcacaggtccgcagtcctgacaaaccaggcatcattacatcaagaataaccaaatccgtattttcatctaaatgttccagaccctgtctgccattctccgcctctgtaacgctgtaattttcgctttctaataaaatgcggacaccttcccggatatccgcatcatcttccacaagcagtacacgttctttactcatatactgtacttcccctttctttttgaatgctgcctatctgttctcccagatacacttctgtttcctcatcacgctgggaacgttcctgtatttcattctttatttttacgcggtttttttccaaaagtataacgatgctggaaccgccaaactcaaaataccctttctcctgtccctgcagcactttagaactgcaggggtaattctgaatccttcctactaaaagtgctccgatttccatctgtattatatgtcctaaaaagtcagattctatttccacatattctcggcagttttctataaaaaccggtgtcgaagtgtatgccaccgggcgtacacaatgcagcttcccttctactttccggcattctcgcagaatcccttcacagacatagcaatacctatggtaattcttcggcgttaaccgaaaaatcaaacaccatccaccggaaaaatgtttcgccaattctctgttctccagcagttgttctaaatgatactcaatatgcttgattcgataagtgctgttttttccaattggatatacggtcagatacccatcacaagggctgattaggtgctccggtgtgatatcaatccgtgctgcacgccgtctgcgtgtaaaaaagtcattaaaagaggtatagttttccttttcatacccatttaaatcaatccgatactttctcacaaacagcggtacaagccatcgggaaaacctggaattcaaaaaaatactcacttttcttgatacctggggttttacaattcttttcaaaatgctccgtccgggaatcgtatgatataaaaatcggataaacagcgtatctttcttcatacttctaatcccagccccaataacaggataacaaattctaccactcccgtaaatataataccaatttttcctgccagatacggtttctttattttaataggcagtacaaatgccacagccatcatgacaagaactgtctgcagagttcctccataagccagtttattttctatcatatagcagacaggcacaaccaatgctgctgcagtaactgggagtcccagataccacgcccgtctaccgccttctttttcctgcctttcctcttccataacattaaaatatgccaaacgaatcagtgcacataacacatacaaagctgctgtcaaaaaagaaagatatgttttgccgctgatactgtatgtaagcaaagccgggagaatgccgaagcaaatcagatcgcttaaagaatcaatctgaatcccgaactgtttttcccttacatccctttgttttgtcgctgcaactgtcccatcaaacatatcgcagattccggaaatcatcaggcagataactgcctcccggtatttgccttcagttacaagcacaattcctgtaaaccccataagcatgcccaaataagtcaaaacgaccgtataattatagtatccacatagtttttttctttcttccatctctcttctcaacctttccctgcggtttgcaatgacagcttccttctgccatatggagtgcccatgcttatccgcagaattccccttttattatatatcagttctatctaccgagtgagccggaaaatatcaagctgtatacaaaaatacaccagggttttcccaaaacaataatcgtcacaaatttgcggacactcattttggtaattccggtaaaatagcaaaaataatcgtctggaaacaacggcagcaccatgccaagaaatagaatcccggtataggatttacttttagctgcccagtccgcccacttttcataccgttcccccggaaacattttgccgactaatccccgcccatatcttcttgccagtaaaaacgcaataatagatcctgcggaaattccaatataattgcaccaaaaaccacccatacaaccaaacatgacggctccgacaacgcatcctaagaatcctggcagaatcggcagcactacctgcgctgcctgaatggctgtcagaatgaccggggccatcaaaccaaatcccgcgacgtacttttgcagagtatcaacagagtcgaactttccatccaaatatgctttaaaaagcaatgcacaaaagaccagacatacaagcagaaatagcgctgttgtccactttttccagctttccgtttgcttaattctcattattcctaatcaccttcaacgatttttccattttctttgtataatcttccgcttctttcatccatgcagtatagaacctctcgcccctgtggtcagggagcgcatactgcttaactaaaaatcctcccagatattgtgtaaccttcctggcacccgacagattcagatgatcacctttatccaaagtgtcagtattccagtcaatctcaacttcttttagtttcatattcatatccagatattccagatcgtgctcctttgcatatacatcaatgctattgtgcctccgatagttataattcaatggagacggcgttcccaatagaagcagttcggccccattttgcttgcaaaggcttatgataatctccatataatttattaccgtaggcggaatttcctctttctgctcggtctccagcatataatcgcctttttcatatggctgtatgccgcaccgtaacgcaaaacctttgaaattttcttctggatactctttatccatcacaaaagatttccagatatcatgcccccggaaaatagggatatagttgttcgcccattcttccagtgtttcttttaggttagtcagttcctgccccaatcttcccctgaacatagtatttgtttccaatataaccagcttgggcgattgtgcagtaaatgcattttccagcatatggtatgtttcctgtatcttttgtcctgattggccgcaaacataagcagtaatcccatgattcttccacaaatccattggcgagactgatgaataactaagactatcacctacaacaatcacatctatgctgttctccggctcccttaaaatccgaaaggtacttttattcctgctctgaaccaaattatcattttctatgtatgtcagttctattttttctgatacacctactaaaattacaatcagaaccgtaaaaaatacaaaccgttttcctgctctttttcgtattcttttaaaatcccgcataaatcatgtccacctgctgataaccgcttccgtaggctccaaagattaccaccgccagaatgagtccataatagaccgcccatctgaacggaagacacaatttcccgattccttcttcacccagcagactcctttcttttatcattccgaccacggccaccaccatacacccagctataatggcataatagtctgcctggtccaatccaaaggtaagcagcgtcccatcccataatttctgcaactcgaaattctgaaacatacttctaaacatccgaaatccggcagccagaccatttgcccggaaaaacagttctccaacaaatataataagccaagtttttaaaatctggggaaccttataataaaacgcatgctcattcaaatgggtatattttatgattctatttctgatcggctcaagagcgactccggccaggagaatcacaaaataatacatcccatagaaaatataactccaccttgggccatgccacagaccgttaaacagccacactggaaataggcaaaacgcagagacaccaagttttgtgatgtacttccccaaatgttttttcccaaatttattccatttttttactgctgcagataccgataccggataaaaaatataggttttaaaccatacgcccagcgtgatatgccaccgtctccagaattctgctgcattttttgaggcaaagggctgacagaaattttcaggcaaagtcataccgaacattctgccactccctatgatgatatccatacaccccgaaaattccatatagagctggatggtataggccacagccgcaactgcaattatcactccatgataattctcataatgctcaaaaacagcctgtaccaacacatagagacggtctgcaatgaccatttttttgaataatccccacagaatcctgatacagcctttagatatattttctcctcttagggaagtccctgcccaaagtgtatctgcagtctgggaatacaggctgattggtccttccataatctgtggaaaaaatccaaggaataatgccaccttccctggatgctgctgtccgtcgattttaccccaatagacatctattatataaccgatagcctgtaaggtgtaaaaggagattccaatgggaagcaccagtattttagcctctagtaaaagttggcttcctacaccatgcagtagaatattcgcattttgtatgaaaaaattatagtattttagatatgcaagtacagataccagtataaaaattccgccagccagtattcgtttctcttttttcttatattgtttcttaatggcatggctttcttctccgtgcaatcctgctatattcattttacactgaagctttactaaagaaatccatatgcctatgtaatgggttaccaatgtcgtccccatcagatagaaaaccagtttcccgctgaccgtccagaaaaacgtatagccacatagcaataatgtcatccatcggaactttttaggtgtcagctgataggcaagaagtgctgccggcagaaagaggaataaatatatggacgtatgataagccatatcagttcccctttaacctctgcaccattttccatatagcatccgcagagttcagattctcaggaacaatttcctccgcctctatttcaatagcaaatacttcttcaagctccgagataagagaaattactccgaaagaatccaacagcctgtcgtcaatcaatgaattttccttcttccaatcaatactttcatcaatttccattaaaatgttcatcaatgcttccatcgtctatcttatcctccatattccatttatatgtctccagttttttccttgccagcttccatcccatttctttactataaaacgcagcctgcggtaattcatggcttaagaacatcgccattccctccgtcattgcataagctcccacacgttcaaaaatcagcacattgccaacccttaaatttttaattgccacattctgcaccaatatatcattaaccgtacagagagaaccgcagacggtatatgttttttctatcccatactcgtgcgctgggattacctgaaatttcggacaatacatacctctaatctgtccatcataataaatctgatgaatccccccatctacgatacaataattcctgccgttgttccgcttaatatctttaacgctagtcagatagtatccacatcttgctgcaagtgcacgacccatctccagcatgacacttcctttccattgcattgccagaatttgagcggcaatcatacggatgttctcctccaccatatcctgctgtccatcaaaatatgaaacaggaattccaggtccatactccaattcttctatttgaaatccggatcttttttccagttccctaagaaaaacatccagatatgtcaactccttttttatcttttccattgattttttctgtgttccggaaaagtaatgaattccctgaattttcagaaacggacacttatctctcatggaaactatattttgaatgatttccgcctccatgccaaactgatttccactagtcagtctgagatatacatgaatcacttcattattcgcatcacaccaatctgcaaaggcgtggaactgattcaaagattcaatggtataggtacatgctcccttgtaatatctcagaattgaatagatgtcctctttttctttcagcacccctgatatcagtattttttcaggctcgatttcaagttttctacaaatttcaaattctcccattgagcagacttcaatccggtctattagggcagtcatctgccttgttagaaatggattggctttcatagcaaaacaaagccctgccttccctgccagttcattccgaatgcacaataccgtgtctttcatttcgtccatattgaatacatagagaggtgtaccatatctcacaattccatattccaaatattccatatccatttcatcaccccaatttctgccggaagtattcccggtctatttttccatttttgtttaatggcatcaaatctgtttttatcaacttatgaggaatcatataggccgggagttttttcttcatctgtttcaaaatctgttccttactgacattccccatataaaataccaccagtctgtttgttctctgatccatcaggcataagcctctctccagaccatcaatctgatccattgcatgctcgatttcttctagttcaattcgatgtcccatgtgtttaatctgaaaatctttccgtccagagaagtaaagttcaccatcttttccgtagaatcccaaatcgccggttttataacaacgtccctccccctctccacctcgcagataaaatataaatttctcttttgtttccttgggattgtgataatatccttccgacagcgattctcctgaaacacaaatttccccaactattcccggagatataatttctttatcactttcgtctaaaaggaacacctccctacccggaaatgctcttccaatcggaattttttctccgtcatgcaacatttcttttacccgataatacgtgcagttgcaggtaatttccgtaggtccgtataaattaacaaattctgcacttggtaaagccgcctgccatattctgagctgttttaccggcatgacctctccgctgaaaagaatcttttttaccgtcagaggcacttgataggtaaatccttttaatgccgacaccaaactgagggcggatactgcccatataagtgcggttacttcctttttacaaagataattaagcagtacaggcggcgtagaaaacatttcttttggaataataacaagctctgccccagtaaacatgctggtataaatatctttcaccgacacatcaaaatcaaaaggcgcctgatttcctatcctgtcatgaactgtgaatccgaatgtctctacaaaatgtgtaataaaatccattgctgcccggtggctgactacgattcctttcggttttccagttgaaccggaagtaaagattccatacaggatatccatatcccgacagtcactccggatttttttaagtattttccagtctgtctgctcattcatggcatcttttaccaaatatgagttcctcttgtaatctatttgtgctaggagttccctcgtcctgtcatttgtcacaataagctccggttccaacacgttcagaatctcctgtatcctctgcgctggctgcgaagggtcaaccacaacatagaaacatccggcatataccgctccaaacatggctgccagagtgaccgaacttttttctgccaatatgacaattggctgccctggctctgtttttcctgcaaatgctgtccccatcttcctggatattcctgccaattctttccaggtaaatgcaaagattccgtcgtccaacgctgtgtgacaggggtattgctgttctgtcttttccaaatattctagtatattcttcatattgttttcctttcaggaaaaatgggccgcatgttcccatgtggcccattatgcttaattattctttttgtcttatgttgtcgaaccacttttattggatttctgtactgtgctgtttttctttgttgaattttttttagttgaattcctttgggttggcttcttttgggttgaattctttgtgtcagactctttgtctgctccatcctgcgcctttgtatcgtctgtcttattctgatccgctccggtcgtattctgtggtttttcaatatctgcatcatcctttttctctgtctgggaagatggtttcttatttgtctttttatttttagattgctcagtttgtgttttcggcacttttgtatctgatttcttatcctttccaccacaggctaccaaccctagtgccattacgccaatcatacagaaaacaagccctttctttaaaaatcctttccatgtcttattacgaaaattattcatggttaaactcctctctaaattgcggcatatatcttactcgtcatcatggtttcccctattgggattctactatgtactccctttttctgtcggcaatttctctgccagacaaataaatccactggctttctccttttatctcctttccacaaatttcaaaagctgttccttttgataagtacattatggcagtaatatcttatctgtttctaaatgaattctaaacaaatctaaactctcattcttttttcgtctgcggggcctttgcgcttggtgtcggcagtgatctggcggatagaaagctgattatgaatggggaatattccaagattagttctattgcacagaagtatatggatgtagctaacaaatatgcggtctaagaaagataaatgcattaaggggacttgaatgaacaagtcccccatgcctaaatatcctaatcaactttctgtaattcttccaccacactgccggaatttccaaaccggaacgctagatatggaaccagtactccaagtaatatcagaaccgggaatactatcagcatcggggtaataaggaattggtacttcataaaccacattccctccgacaacttcctgactatagtcaaagagaagatacaacctgctgccagagaaaatacaatggtcagcaatgcatagtaaagcccttccacaatgaccagttttgtcagctggcgcctcgtcatgccgattgcctgcatcatagcaaattctctctgtcttgaaataattcctgtcagtatggagttgataaagtttagtaatccaataaatccaatgacaaatgcaagtgatcccccaaccatcaggaacattcctgttatagatgagaattgttctacatactgcagttttgaagagtaatccatcagtggttcactactttccgtatagctttcaatccaagcatccacatccctatctttcccttcctccacgttgaaggagtaactcataagatacttgtcagatagtatttccttaaagaagtccgcgcttacatagtaagtaaattctgagctgatacggttggttaggttccagtaatcatcttttattaccgagagaaccgtaacctccttctctttatattctccattcaggtccgtataagagagtataatcttatccccgggctggtgcaggactttatcttcatacacttcccctttatcatcaaccaatgtagaatagatgatgtaatcgcccgtggcaagcttttccctgatcgtatctacatcactctcgcccttccatactttcatctcgtccacaataaagtcctccaccccataaaacatggaggaataatcaccattttctgtacttgggattggtatgaaattctttccatagtactcacccggttctccggcttcatttacatcatatccttccggaatcgtgaccccctctttcttaactcccaccttcccattggcagcatagattcgcccgccttctttaaatccgttaatgctctggcatgcctctataaaggattctgtaaggttttcctcgtcaatcgttgcttcgttgcttccatgataatattccgtattgaaatatttggcattggcaattaaaaagtccgagctcgtaaagcttctcagaaacagatccatgtcaaaagagttcgtgactgtaaatacactgtttaaaagcacaaccgccagtgacaaggatacaatgataatcgctgtctttcctttactccttcccagattagaaagtgccatgcgccagattttccctccgccggaagaacgtttccccttctttttctccttcttcccttccgtaaaacgcagcgcctctatcggagagacctttgccgccattttcgccggatgcccggtagatataaataccgtaatcagtgagaataccgccgcaccgataaatatccacgggctgaccggaatatgtgtctccccctgtgcgactgtccctgtagaattcaagatagcaggaagcagtgcttttcccacgaaaaaaccggccagaagtccaatggggatccctatggcagaaagtttcaaagcctgcctgcggatgatctttttaatctgccgtcccgtcgtcccgatcgttttgagcaatccataataacgaatatctttcataatggaaatacggaaaatattatatatgatcaagtatccggtaatcaggatcagcacaagagctcccgctacagcgcccacggtggcaggatccgcgtccgccccgtcagaaacatatgcccagttggcattgcaggctatataattgtcatctcccggttccgttgagaatccgctttccgtcagcacctgatccagctttttctggatccccagactattggaaaatataacatccatacggatggcgcccatagtggatccggtgtcatcctgccccttatactcaagttcctgtgcatatttttctacgtaggcctgggataccagggcaaatcccacatcgagagccggatctgatttgataaccccggacacggtaaatgtgcgctctgttatggtttcatcataattgtgcagctgcaggtccagagtgactttctgtccaggctcttttggaagacccaaaagctccagagaagtctcatccaggaggatttcgtctgccgctttcggtgcttttccttctatgatgtctatgaaacagtgcgggtaggcttcttccggatagtaccaagcctcggcatggcgttttaaaaattcgggattccggacataatccgccacaagccggcatggcatgctctccttaatcagcgggtgtgctttaagtttctcatactcctcctgtgtaagttctttgaataccccgtgtgcatcgccgccggactgccttgccgtctgtctttggaaggtatatacggtcccaatgcctacggaaaacagtgccgagaacagcattgacgtcagcgctattgcaaccacggctatcagattccttgtcttattaactttaaagcttttgtccgacaggcggcggatcacctctttgttcttcaccttacgcatggctttcaccgcctttacctctcacctttccgtcctcaatccgtataattctgtctgaaagctgggcgatcccctcattgtgggtaatcattaccatggtttgcccgtaccgctggctagtaatcttcatcaggcttagtacgtcctgactcgtggcagaatccagatttcccgtaggctcatccgccaggataatggcaggcttggatgccagtgcccttgcaatggcaaccctctgctgctgtcctccggaaagctgtgagggcaggctgtagcatttttcttccagtcccagtgttctgatgacttcttttacaaacgccttatcaaccgggtttccgtccagttcaatcggaagtacaatattctcatacacattcagtacaggaacaaggttaaaactctggaaaatgaatccgatcttgcgtctgcggaaaatagtcagttcctcgtccttcagggcgaagatatcttttccgtccacgtataccgtcccctccgttgggcggtcaagcccccccagcatatgcagaagcgtggactttccggaaccgctggttcctacaatcgataggaattcccctttctctacgctgaggtctaccccgtccagggctctcacaagaattgcatctttcccgtaatattttttcagattctctgtctttaatacagccatttgttttcctccttctgatgtttcaataattgtgttacgactcacggcctatggtctgtgaataataacacaattctctcatatgactgaaagggccatatctcctattgatatgaaaagattgcaccgaaatgcaatctcctttcgtatcttctatattacagggcaatcctaactatattctgtctgaatcctaacagttgtgatagaatttcacaataatcaaactcccttccccagataaatttcaaaaaccgatcccttctctgtaccgggcccaactttgatatatccatcattttttctcacaatttgtaaaggccgatgccgacgccttcctcctgctggttgccagctcctctgtagaaacgactaaatatcctgctcctttcctcctccgggataccaggaccttcatcggctgttctgatgcacacatacattggatattcgattacagatactgttaatgtgctgtcattgggcgagtattttatcccattgtccaaaatattaaaaagcgcttcttccgtccatttcaaatcaaagaccgcctcaatactgtcaaaacctggttccaggattgtgatggacttttcctgtgcatgagcttttgcatcccttatggcattttcaaccagaggcctgagcggttgtttcaccggaacaacttccaggatatcactctcaagcctggacatcttcaccagggctttaatcaggaattccagcttttccgcctggacatgaagctgctctgcaatcacctccccctcctcggttagcggctgctcttttaaaagctcgctgtatagaatgatattagcaagcggtgtttttgtctgatgtgaaatatctgagagaatggacttgatgtccgctctctctttgcgtgctgcctcaactgacagcttagaggtggaaagatactgtttccatctggattccagccttgaaagctctgtctcgtcataattgacttcctgaaatgtaccttccatggcctcatcaagcatctgttccagacgtttcatcgttttgttcgttctcaatatgcccatcgtctattcccctttttcccacacatacccgattccatagacagtcctgatcggactttccttctctttcagtttcagttttttcctcagcctgcccacagcaaccgacagagcattctcgtcgatataatcagatccctcctgccaaattccctcgtttaatatttccctagttaatgtctgtcccggatgcgatataaacatgcgtagaagcttctgctccgtacggctcagttcgatcgggttccccagaacttcgaacacctgcctgtcgaacgcgaagaaataaccgtctttttgataactgcttcccgtatcattttccaggcgcgcaaacaggcgctccactctggcccttaaaaccatcaggctgaacggtttcgtaatataatcgtcggcccccatctcgatccccctgacctcatcgatctccatatcgttggcagtaagcatgataaccggaacactggaagccgtacgcacatgcccaagaaaatcatatccgctgccgtccggcaggttgatgtccagaagcaccatgtccacttctgctgtctcccagtattccagaccttccttcaaagaaaaggcttgcagaaacttccagtcaggtttccttaaagccagtgccacgccttggtttaggcccttgtcgtcttctataattaagattatttttcccattttttctccttcaaacacactataggcctccactgttttctgcattcactttccttattaccagaccatttttttcattccattcagaattaatgatatggatactacactctggtggaatatactctgcattgccactctctgaatcatatactacaagcaaaaagcccggcggcatagccccccgcagccctatcttttcttttgatgcacttttttccacaaaagcctgtacttctaaaattaatttcttacttattgttccggttatagaaagtgattatgtggatcgccatcaatcacatcatttacttgtccttttgtaagtggattgtcttcgaatttctccacaaaactattgtgatacatattccaatactttttatacacaaaatcatcattaccgtcaaagttgagctgatacattctaaatatgacaggaaaatttttcggctgccattgctcttcatatgaatagcagtatttcatacctaacttcttcataacattgccgcttctcggattgtttctgtcatgtgttgcggtaatatatagcaaaccatctttcttcacttgatcaacaacagctttgcccgcttcggtaacaattcccttatgccaaaattccttacgaagtccgtaaccaaaatcatgatgttcctccatagctacattgatataacctataggaaaattatcttctttaaggcagatagcatacgcataggctcgcggctgtgcatattttgaaatgtatctttccttataaaattgctttgtttcttcaaggtttttcacggcataccatggcaggaacttattaacttcttcatctttcagaataagaaagagcgcctccatatcttcttctgtaaattttcttaaaatcaaacgttccgtttctaatacaggtgtattcatgctattttcactccatgatttctaatttctttgatcttattaacatgcctccgccttattctctgacaaacatcctgccgtgctcaggaagtcccgtttcatcagacacatacctctccactttcatatgcaagccatatttttcacgcaattcaataatcttccccatcgtgggtgatttatggtgtacatcataataaaaaggcacttttcaaaatttgctgctattaaaactttgtgctaaggtctgtctcactcatgtcctgtccctagatattgcctccaagaacattagctggcactcttttatttacgctattaatactttgctgatgattggtttggtatgtcattccaagtctaaccttgataaataactagtgtcaccagttgtccggtaccgaaacaatcatagccaatgcaacctttcattttctgctttttaagttgcaaatgtattttacatcggtaatcttttaacaaatttgtacatggttgccctgatactttatctttcggaaagccatcaatttttgaaaaaacagagcagtacaacacaatcccgaacagtttgaacaatctgacttcatatgttccaatattttatcatttctttcatgtatcatcatatacttttagctcctacaactttcgatttgctattctaattataacacttccactaccaagtatccacaaccatctggagcatgacagcaaatgccatgcccctactccatactgcaccaatgacctctcaatcccatatctttttatgattttggccatataagtcatactgttttctagcttttgcattaggtcagtttacaaggaactacacgcagaccacgaaacgggggctgctgacaacaaaacaggctgagtatcaagcgccggaaaagtgcgagatattcagcctgtttttttgttcggggtttccaaaggggcttgcctcttggagccgacatcagacgctttgtaggttgcacttattaaactgtttttttccagccgtagcagtcatggataaatagaagcatcctctgttcttcatatcgtctttaaccttttcctttcccgtccgttcttcagcctgagatcagctcttttatccacacagacatctcccccatcccccggttgttccaataggcataaggaatcgctttcaatgttacatctgataattttacaggatattctccatacagcactttttcatcccaggcactctcttccattcttttcccttgcagcaccagctctgtgatgccgccaaatagtttagatgatacttcctgtattgccttctctgtatccacatacaactctgccagatttttcccgttatcaatttcctccaggcaatacacaaggggacctttcaccattgccgttttgccgcagtcggcgcgtacttttggatttgcacgtacaaattttgccggtgcttcaaaagaaacactgatatctgaatcctctgtaagtacaagatacgcataccctttttcttctttatattccagaagttctccttttgcggtcacctgatacattctcgcgtattccggtattctcactgccaatgtcattccatcggccggcacacagccgacttttatcttcaccaagttctcaaaaggaaattttgtttctacagaaactgtgatctcccctgtcttcaactcgatgcatgcctcgtttgaaataaagagattgacatacagagctgtctcaccaatagaatatatgtactgccccatagaggccagagttctggctatattaggaggacagcaggcaacaccgaaccatttctggcggataggtttcacatgttcttttgaggtgcgttccatacaattatcaggccacacttccagaggatttacatagaagaaacttttaccatccaaagcgatccccgccagaaccgtattatacagggcacgctccacagtatcaatataagaggcatcctttgttatgtttgccatcctgatgccgaacatagccagaccgatggaggcgcaggactccgcatagctgcagtcattcggcagatcataatctactgtaaaacgctccagaataccggatgcgccaatgccccccgtaatatacatctgtctctgtactatgttatcccagagccttttacaggctgccatcagatcttcgtcctgatattcatatgccaggtccgccatagcgctgtacatatagactgctcttacagcgtgcccctctgctgcttcctgctcccgcaccggtctgtcagactgggaatactcgggacggtaatctgaaagctccggaaatatatttccgctgtcgcctctgctgatttcctgtagaaaatagttctctcctgttccacgcgcatcaataaaatactttgccagattcagatatttccgttttccagttatatggtataatttgatcagaccaatttccacttcctgatgtcctggatatccatggtttttcccatcctcactgccaaatgtatcacagagcagatccgctaatttttccacaacacccaggaatttatccttccctgttccctggtaatatgctactgccgcctccatcatatgccctgcggtatatagttcatggccttcccgcaggttcttccaccttttttccggctcttttataataaaataggtatccagatacccatcctcctgctgcgcctccgcgatgaaatctatgaccgcatctgcggtcttctccagctcaggatttttctctgctgccagagagaagcccactgcctccagccatttggctatatctgtatcctggaataccgcgccgtaaaattcccccttttttctgcctgccgcaatcgcgaagttttccaggcagtgggacggctctgcatccgggatacgatcattcatagcatcccactgatagggaataattgcttcttccaccagttttacatgctttgtccaaaatggatcctgaatttttattttttttaaattaatagaatgtagtttcattgtattcctcccagtctcccagaataaagcctatgccttgactgctccgttggtcagaccgctgacaatatatttctgcatgaaaataaagataagtaccaccggcagaatcgctatgataccaaaagccatagtagcgttccacaatgtctggtattgctgcacataattgtaaatgctggaggtgatgggtcttttcataggatctgtcataaatgtgattccatagatcagatcgccccatgcgtatacaaaagagaatacggcagccacaataacgcccggttttgctatgggaagcatgatcttcgtaaaggatgtaatgctgttgcagccgtcgatttttgccgcctcatctagttccttcggtatggagaggaaataggtcctcaggataataatactgaacgggattccaagggtggcatctgccaggatgggagccagataggaattcagcagccccatctttgagaacatgatatacagggatgtcaggatcagggttgacggaagcatctgtgtcatcaggaaatataaaatcagaatctttctcccgctgaatttaaaccttgccagcccataagcggcaggaatggacaggatggtagatatcactgtggctcccactgcgatgataatactgtttttaaagcccctaagcgtatcgctggatgcggagaactggtctgcaaatgcgtccagagtcagattctttggccagagaggcgtgggaatctggaaaatctccacctgtgttttcagcgctgtgaccaccatccagtataatggaaaaataaagatcacaaatacaatggctccgatgataaaaaatttcaggtttcctttttcgttcttcatctcacatcacctcgtcttcatcattgatcagtttaatatagaaaataccaaccacgaacaggatcaggaacagaatattggctgccgccgcacccttactgaactgaaactggtcaaaggacagcttgtaagcataggttgataccagctctgtggaattgaccggtccgccctttgtcatgacccacaccaggtcgaacactttgaatgtatatacaaatcccaacgtcagcacagacatgatagccggctttatcatggggatcgtgatctggaacagtgtctggaatttatttgccccgtccagacgtgagctttcatagatctcctccggaatggtggtgagtcctgtgatcagaagcatcatgttaaaaggaataccaatccagatatttgccactacaatggctatcatagccagtttcgggtccagcagccattccagcggcgcgttgatcagatgcagggacatgaaaagctggttcatgataccgcctttgctggcaaacatgaatttgaacagcagacctgcaaccgtgactggaagaagccaggagatcatggtcacacctctgaagaaagagcttcccttaaattttttgctgaacagaagtgccagcccaaatccaataaagaactgaaagaaaatagacgctactgtaaagatcagtgtatttctaatggctgtggtcagaatcgccccaccacctgaaaacaattccttgtaattctctagtcctacaaacgcctgttttgacgcatccgcaaaggaatatacatccacgtttttgaagctgaggataaagttctgtatcatcgggtatcccacaaatatcagcatgtagatggcggctggaagcgcaaataaaaatccaaccttcggcccgagagttttcccttttttcattatttttcatcctttcttatgagcagttatggggttaaaaagggacagggggttcctgtccctttccggctgtttatttttctgatgccttcaccttatccactgctgcctgtgtatcttctgctgctttttcaggagtcttcgctgaggtcataacctcctggaaccctgtctgcagtgcatcggaatattccggccaggaagcgcttgggcctcttgggatggatgtctgaagctgtgtgatgaattctttctggattgggtcgtccgtccagtatgagtcctgtgccgcctctgttttcggcgggaaggaaccgtactgtttcatagcgtctaccatcacctctgtcttgtcatagtattccatgaatgcagtggctccgcccatgtcatcctgttttacagcccccatattctcaccgcccagaatggaggttgcctggtcagaatccccgtctttttttgggagtaccgtcacaccgtagttcagatcgggagcatccttttcgattcccggaatctgccatggtccgttctgctgcatagccaggttgcctgccacaaagttgttatttacatccgactgtgtccagttcacgcagtcctttgaccaggaaccgtcagctaccatttcctgcataaggttgtaggcatcagtaccgccttttacattctgataatccccacctgctgtgtataaccactgcagacactggaaggttccctcatctgttcccgtggcagcattgccgaagccaaccacaccatcttttgtcagcgcttttgccatctcatggaaatcttcccatgtggtgttttcattgggatactccatacctgccgcatcgaagatatccttgttgtagaatagtgctgtacagttagtggcaaagggaatgccgtaatgttttccgtccgccatggtggattccatggggccttccagatattcatcccatttgatatccgcatccgatacatccccgaaaaggtccatctggatgaaagatgccatgctgcagccgtccagtatgaccaggtccgggagttccccggatgccatgcccaatgtcagttgtttttcatagtccgcaaagggtacatacacatgggatgcctcgtattcctcctgtgattcattgaagccgtcaatgatgtcctgcatcatgttcttctgggcatcggtctcaaagtaatcccagatgacaacctcttcctttccttcggcagtcttcttactgctgtccgtccccgctcccgcggaagctgttcctgtgtttcctccgcatcctgccaacattgtggctgccatagccatacagagcatagcgctcactacttttttcctcattttgtttcctccctttcgtacgtttctggttctttatttgatatctaaagtataagagaataccgccctgtcttatagtctaaaaaattaaacagggtggaaattcttcaactgaatttccaccctgtccatgttctgcatctatttctttattgtttcagagcttcctgtattctgctgcaaacatcctccggcgtgctcattcctgtgatgatctcatactgcccttctgataactgttctgacagaactgaccagttctcaaaactggtccttgagatgcagctttccatctgctccaatatgatcccgtattccggctttgctttcaaaaacaacttcgctacgtcttccctgggaggcagagagtttgccctcagattcgcattcaacattatgttgatctggctgtaatattttaaaaatgcaacgcttccctctttgtttttccctttcagcactgctatgttctctcctccacggacccccatatatcgttgatccccggggaatgccgcaacaccgtagttgatgccagcctcatccagggcgggaaatacccacggtccgttctccatcatagcgcactcccccgcgataaaggtccttgccacgtcattctgggaccagtttacacattccctggacatcaagccctgctccaccatattctgtataaaccggaatgctctctgagtcccttccccgcctgcctgctccaactcatcaccggctgacagcataaaggaagcaaattggaaagccccttgttcaccgctgaccgcagacatggcaaatccgaagcgcccctcctctgtaaggctttcggccgccgcctcaagctgctcccaggtttcaggaacctctatattcttcttttccaaaatgtctttattatagatcagtgccacattgctgcagcaagaaggcagtccataataacggccgtcatattccacggattccatggcatttggaaaatactgatctaaatccgctatctcttttacagcctcggtaatatcctccagtttatccatgttgatgtaggagggcatatccggattatcgatgatcaccatatcgggaaactggttctgggtgattccgatcgccagtcttttgctgaattccgtcaccggcccgtgatattcccatgtgaggtgatacttctcctgagagtcgttaaatccctctgccagttcatccatggatgtcctctgattctccgtctcataataactccacaataccagttcctcccgctcttctgaatcacggactgcttcactgctgcccacagaacatccggccaggcacaaggcacaaaaaacagcgatcatactgcgcatagctttcatgtttattcctcctaattcatctgcctgtattcacctggagatacgccggtctcctctttaaacaccctttgaaaatatttgggatcattatatccggtggctttcgctatctcataaatcttcatgtcggttccttttaacaaccgcttggcatggctcagacggaactgcttcagaaaactggtgaatgtgattcccatttccctgttaaaaagggtgctcagatattccggcgtaatttccagtaccctggaaacttcctcctgcgtcagcccttcctggtagtgctgccggatataattgattgctttttttatcacgtaattgctgatatcctccctctttaccctggtactggtgatgagcaaaatgacatccatgtatgcgttctctaattcattccatgtaacagctgcctcaatatttctgagcaggttggcacttttcagatgttcaaagagagccctgtctatatcctccagggtatcccctatcatatagtaattctttacaaatgccctgcggatatcgtctgcatcaaaatgccccgtttttatatagcgcagaaattcctccgcaccttccttcactttttccgtatccccctggcagacagcattgcgtatgcgcgtagagatatccgcaggcggcagaaaagccctggactggtatgcttccacagcctccctggtaagccagcccttctggtcccatataagggaagaagaaataagatcatccagatcctgtgccgttttcttcagatctctcagacttttgaaagcctgtctggtccagattgcccgctcgtccttatcctgataatggaagatcaaccggttgtaaaaagatttttccaggtccgaaagcctttgaaaccctacatctgcgcaggccagaatatagaacttctgcagattttccatataaaaagcgtaccacttcacctcacggtacttttctttcagttcatccagcgctatctccgcatattccctataggaagcgggggcagaacctgtgtatccggcaaaaagcagatattcagcctgttgtgccagaccgcagacattcttcagtatagcatactgattgtcttcctcatgctcttccccgtagagcagattcctcagatgcgtctcgggggtcccctgggtaagctgctcttttttgatcctatcctcaatctttaccagcatatcctccacgtcatccactgacaaaggcttcagtaaataatcatcaactccatactttatagcctttttggcgtactcaaattcggaatatccgctcaggatcactgcatgtatcggtattttttgttcgtgaagatgacggatcatctccagtccatccattttcggcatacgaatatctgtgatcaccagatccggtttgaaacggaggatcaggtcaaggccttcctccccgttggaagcctctccaaggacgatatggtctgtcagcgattcgataagtttccccataccttcgcgaatttttatttcatcttccacgattatgatcctcattggctccactccttatcctgcattggtattttcagtgtaataattgtccccatatcctgtatgctctttacatcccatgaaacctcctcaccgtagtacatccgcattctggcaaacgcattgttcaggccaatgctcctgccgtcgtctctgactgctgtctcgggatcattaaatatatctgccatgccgggcggcatgccttttccattgtcttctatgataatatccagttcttttttgttctctgacatgatgatatcaacccgcaggattccgcctccctcaatgcctttaaagccgtgcagaatcgcattttcaacaaagggctgaatgagaagcttatggattcttatgtttttcgcctcttcgctcacatatacctcacagataaaagcattgttgaaacgcattttctgaagactgacatacttttcaagccagtctgccatctctgcgatggttaccatctgattgcttttatttatgctgtaccgaagaataataccgaggttgcgcagcattttactgatttcatattcttccttttcaatcgccatccagttgatagagtccagtgtattgtacagaaaatgtgggttgatctgagcctccagtgcccgtatctcagcgtttttctgtttctgtgtgatctcggtcacctcggcaattagattcttaacttttccggtcatggtattaaagttatccgcgatctgtcccatctcatcctctgtatccacatgcacctggatgtccagattgccgttctgcacctgctggatcccccctacaatgtttcttgtagacttctcgatcagccttaccgtatagcgtatcagcagaatggaggctgcaaacagcagcgcgccgatgaaaatggtcagatactggatctttgtcacatcacgcagcatgtaatccctatcataggcattataaaagatccatccgagcagttcgtcctcataacggttcacagcaatattcctgcccttcagttccccggtattttccacaaaatccttgatcgtcttattggaattgatggctataccggagtaaaatgagttgggatatgtcagtacattgccgcttcggtctgtgatgaaattaaccgcgtagatctctgaaccgtcctcggtctgacccctgccgcacactgcgtttaagacagattcattgacgctggtcaccacagtggcaatgggaccctgctggatatctttgaagtcatacatctgctttgctatatggaagatccgttcctcctggttcgcccgcagaaaacgctgggtgggagatatgatcatattcgttgcatcctgcgcctggcggcagggttctatagacgtcatatcctcatagctgttccagagattatctacagcggaggccataccaaaatcatatgtaatatcctgcccgtccggcaggataatgctaatacactcaaccccatagacagaagttccgtactgctgcagtttgtcacaaatttcccggcagatccttgccttcacctcggaatcttctgccttataagatttgattccctctataatctgattatccgcatagatctgatatacaagatttgtataaatatccagcgtcagattcgtcctctctgatatctgggcaagctggttcaccataagggtgtttaccttttctttcatgttgtttacaatgacatagagcatcaatatctgtgccaccagaagcggtatgaccgatgcaagaatgaaggtatataaaatcttccggcctaatttttggttcttgaaccattgtaaaaaacctttttttcgtctcattattatctccaggttctttttaataacaaaatgacaaatatcataacagcatctgacatgagttttatttaaattattatacttaaaatacttcttacaaacaagcataatttaaatggaagaaaaaatcgtctgtatgctgtgttccaagtatcattccccctgttttttcaaaggtatcggtaaatccttctataccgggagttcctatctgaatacgatttctataaatgtgcaatacttctatgtactcatccttgatctcccataagagtttggttctgaaatacgcgttgttactgctgatatttttaataaactgatgttttagtttattaagcctcatttctgtaaacaccctgaacttctgttccgtaaagctttcaatactttctcttctcatatatattcaacagcttgctttcctcaattggtctgaaaaaatattcatacatcatattatccagtcttccattgtctctcaaaatacctgcataatcagaaataacaattatgatgtatgctgtagttacctatgcaaatatgcgtgggatacggactgttgaccgtattgttgaattgtgcgaaagagtccttgcttttatctggcttactgcaggccagaagcccaggcgggatgctttttatgattttaaaggtaaaaaataaccgatgaagtcttggatgacctgaactgccagttcctgcgtcgcttaaaaaggaaaggactcatcacgctcaaggagcttttattgacggtacaaaaattcttttgcggccccaaataagcttcattagaaaaaataagaatatgccgtggaaaattatgtgctggaaagcacctaattccacggcatcttcctattctttggtaaaggacttaaaaatcggtattaaccgacagcccctttaaccctctactcaaactcaatagtagccggcggcttaggagacatatcatagcaaacccgattcacattctccacctcgcccaatatcctctcggttatcttctccagcacatcccagtctaccttctcaatcgtagccgtcatagcatcgatcgtattaatagccctcagtataaccatatactcaaagcatctctcatggttcttcatccccacagatttaaaatccggtacaaccgtaaaatactgccaaaccttcttatccagcccggctttctcaaactcttctctcagaatagcatccgactccctgaccgcctccagccgatctctcgtaatagcgcccagacacctcacaccaagtcccggccccgggaatggctggcggtataccatactctccggcagtcccagttcaataccgcatgcgcgcacttcatctttaaacaactgtttcagaggctcgacaagagcaaactgcaggtcctccggcaatccgcccacattgtgatgagattttaccatcttagccgttttcgttccgctctcaataatatccggatagattgtgccctgtcccaggaacttaatcccatccagtttccgtgcttcctcttcaaatacacggatgaattccccgccaataatctttctcttctcctccggatctgcgactcctgccagcttatccaggaaccgatccgttgcatccacatagatcaggttcgcatgaagctgattccggaagacttccacaacactctcagactcattcttccgcatcagtccatggtttacatgcacgcataccagctgctgcccgatcgctttgatcaaaagcgccgctactacagaagagtcaacaccgccggaaagagcaaggaggactttcttatccccgacctggcgcttcacaagctccacctgatcctcaataaagttcttcatattccagtttgcttctgctttgcactggccgaagataaattccttcatggtctcgtcatccggaaactgatcatactgcttctcacattttgcggtcggatggtctacggaaatcaccggatatccgcactcgtataatgccgggctgacatcgactgcctgtccgtcgacaatgcggttctcaccgccgtttaatataattccttttacattgtccagtgcattcagctcgtccacggtgatgtcgtgagggtgaatctcactgtatacgccaaggctgcggatttgacgggcaagcacggtattgttggtacttcccagatccagaataacaatcatgtcctgtttcatttgttttcctctctttcttataccatgaacccaaatcggattccccgtggatttcggttcataatatattcgtacattatttctttctgatttttctatgagcgatacatgcaaactatgtttcatggtccgctctgtatgcggctcccgctcatatcatagaaggtcaaaagttgatccaacggctccatacttttttatagctacgaacacttagcggctgtattttggccgcttacgtgcgatgcataaaaaatagttggcaagatcctttcgagccttactattttttattataactgaacccgtctttattttccatctaagaaatagaaataacacatatttttctctctgcatataataattaaaattgtattttgtcaggagtttcacaatggaatatccccaatacgattatgcggtcattggaggagatatgcggcaggtatatctggcggaagaactggcccaccatcagaaccgtgtatgctgctatgccctcatggccgcgcccgacgagcgcaggtactccgatgcctccgttgtaaacgcggtttccggacttcgggaggcctgtgccggatcccgctgcgtcattggtcccattccgctcagtaaaaacggtcgtgatatcagccagaatgcgctggagggctgcctgcatctggatgctctgctctcctctctgaactccggctgccatttcttttccggctgtattccggaatcttttaaaaatgcggcgctggaaaagggcgtttctgtccatgatctgatggaacacagttcccttgcttactacaacacgatagccacagcggagggcgctttgtgcgaggctatttccagaagcccgcataatctccgccagagcagttgcgcggtccttggatatggaaaatgcggccgtacacttgtccaatatttaaaagccctgtgctgccgcgtctttgtcttttctattgatgaacaggaatgtgcccaggctgctgttgccgccgatactgcgatgcccctggatgctcttttgaaacacatcgggaactttgattttatttttaacacggttcccgctttgattgttacggcggaagtactggaaaatgtgaaaagttccgccacgatcatagacattgcgtccgcccccggcggagtcgactttgcagaggcgcagaggctgggaatcacggccgctctgtgccttgggctgcccgggaaatatgccccttcctcctcagcgaaggcggtaaaggaaaccatcgaatccctgctctctcaggagaatacgtgttaatattcacggcctagaggccgcgcatagtaacgaatacgtctcaaattcataaggagtgattaaatatgtctttagaaggaaaaacaattggagtggccctgacgggctcattctgtacctatgaaaaagcatttgaaggaattcagaatcttgtagacgaaggagctctggtccagactattttttcagacgcttccggcaccattgacagccgctttggcagtgcggaaaattttctaaaaagagccgaggacatcacgggtgtccgccccatgatgaccatatccgaagcagagccgatcggccccggcagtctgctggatatcctcgtactattcccctgtaccggcaacacgattgccaagctggcgaacggcatcaccgatacaccagccctgatggcggcaaaggcccacctcagaaataacaaaccgcttctcatctccatttccaccaacgatgcccttggcatgaacatgaaaaatatcggcctgttattaaacgccaaaaatatctatttcatcccgtttggccaggataatccacagaaaaagcccaactccatgattgcacacaccgagtttctgattcctgcactggaagccgctttggaaggacgtcagtatcagcctgtcatcctttaagcctaagacgcttcgtcatgattctgaaaagtctggaagaagatatgacatttatatgaaaaaggagaagaaaaaatgtgtggaattgccggattttttaacccttacatggattacaaagcgaatgaaccaaagtggaaacatattctggaggatatgaaccgcgcgcagaaacgcagggggcccgacgatgagggtacttatctgagctctctgtgcgggctggcacatgtaaggctcgagatcatcgacctggcaacggggcatcagcccatgatccgcaggtcacagaaccgtgaatgtgcgattgtatttaacggtgagatctacaatatggcggagctgaaagcggaactgatcctggagggagctgatttctgtacgtccagcgacacagaagtcatcctgacagggtatatgctccatggaaaagattatatcaagaaactgaacggcatcttcgctatcgcactgtgggattcagttcccggtgaactctgtctgttccgtgacaggctgggcgtcaaaccgctgttttacaccatgaccggggaaacccttgtattttcctcggaaatcaaagggctgtttgcttatcccggcgtagatccggtattggaccgcgccggactctgtgagatctttgccctggggcctgccaaaacatacggcaagggcgttttcaaagatatcctggaagttctgccgggccagtgcatcacatttgaccggacctcctgtacggaggagttctattggatgctggagagccgtccccatgaagattccatggaaaaaacgatcgagaagactgcgtggcttgtggaggatgcggtcaaaaaacagatgctttccgacatccccatcagcaccttcctgtccggcggcgtggacagcagccttgtgaccgcgatttgtgccagggagctgaaaaaacaggggaaagtattaaataccttttcctttgactttgtggataataaccgctactttcgttccaattccttccaacccagccaggaccggccctacgtagataaaatggtggaatatgccggtacgaaccaccggtacctggaatgctccaatcaggatcagctggactgcctgtacaaagccgtggatgcaagggatcttccctgcatggcggatgtggaatcctccatgctgtacttctgctcccaggtgaaggactacaacaaagtcaccctgaccggtgaatgcgcagacgaaatctttggcggctatccctggttccacagccgggaagcctttgaaaccgctgccttcccctggtcccgcagcatggaaccaagacagactcttttggatgactgcctgatccgggatctgcgcatggaagaatatgcccgagaagcatacgagaaaacaatacaggaaacaccacgcctccccggggacacccctgaggaaaaaagacgccgtgagatcgcctggctcaatctgcgctggttcatggtaacactgctcgaccggatggaccgcaccagcatgtataacggtctggaggcaagggttcccctggcggatcaccggatcgtagagtatatcttcaatgtaccctggcagatgaaatgccccgacggcattgtaaaaggtctgcttcggcacgcgggagaagggcttctccccagcgaaatcctctggaggaaaaaaagcccctatccgaagacatacgatcccgcatacgaaaaactgcttggtgaccagctgaaagaagttctggccgatcccaatgcgccaatccacagcttgctggatactaagaaagtctatgcatttgtaaacagcccgtccgactatgggaagccctggtacggacagctcatggccggtccccagatgttggcctacatgctccaggtcaactactggctcgcacattataaaattcgattctaaaaaagagtaggcgcaccgggaaataatagcgcataaataagacaggagaccttaccgttgtctcctgttttttatgccgaaattcaagtacgcctcggcgtacttgcggcgagacgcgcgtcatgctccgcatgacacaatacctcagcacgtctcctccatccgccggcggctttattttggaaggatattggactcccgccaagacaaaattattacttacccgctgcctatagaggtgggagtcttatctgctttcaagataacactccttgctaaacaggcggttcactctcattcttccctgacaaacataagtacaaatccccccgccagcagagccccggctatccatatagaatgcagcccaatagccctgctcataaccgccccggccgcggcaccaaccgcaaagatcaatatcacaaagtaataatgcatacttttctttctcagcgtaatatcttttgtaatatgatacttacagagcatttctgtggcacttcgcatattgccgatacacatggtagtagcacagggaattcccctgaatttacggaaactgttcacctgcatggcacaggcaaaagacatcagtacattagccagtacatcaaaagaatgcggcagaatccccaccacggcaagcaatatcacctccacaataaggacaatctgccgccagtgtattctctgataatctttatataaatggtgtacccattccgtcacatatactccgctgataaaagcagccagcggcatcagataatgcagtgccgtcccccagtttccctgggccagattctgccccagcaatacaatattccctgtctgggcattggcgaacaccttccctctgcagttgtatgaatatgcatcctgaaaccctcccgccagcgtcagtaataccgccagcaccatagattccgacatctgctgctttgcttttaacttaatcatccgtctaacctccagcgtaaataaaatcatatcctccaccattatacgaccttctcccccaaagtaaagagatttaggatacaagatttggaatatcgggggcggggcgccagaagtaaaatctcatttcccggttgggatctcagaccgaagcaacggatgtgcactggcgacgcgtagtcgttcatctacaaaaatggatttcgtgccgcttgccgaaaagaggtttactatttttaatatagcgaaaaaactctttttcaacctactggggatataaaagttacgccaattctattccatccgctgccccggtctggaatccaaccggggaaagagttccttcctatcggcggatgaacctagcttaccgtgagccgggacggactgtgaaaaacacctgtcctgttggaaatgcttttagcgagcatagcggcagtaagaggaaatccgcgaaatcagcctgaaaaaagctgcttccaaagcagctttttagaacacctgaggcgtttaatcatcagattaaacggtgaatgtgttcggttcaggctgattttgcggatttcctcttactgctgcttggcgcagcggctgtatttccaacaggacaggtgtttttcacagtccgtcccggctcacggtaagcgtccaccccatccgcgcccaagattaaaactcgttccctaaatttcttcgatgatctgttcttttagtacagattgtcccgagatgagtactgctacgatacagatcaggatattgaccgctgccatcagcagaacagtcagcggggacatgcctgccttaggatgcaggtacagatacacatgaaccataaagtaatacaggattttctgtaagatcaggtacatcaccaccatgacaaggctggaatacaggccgtatctcacgccctcttttaccagcattttccggaatcccgcatctgtgatacccatggcccgcaggatgccgaattcgtgccttcttgcagccaccagatactgcatactgttcaggatgtggagaaaactgattaccagaagaatcgctcccacaccgtagaaaaacagcattttctgagcaaggtactggttctcttgtttgatctgttccgtgtaatcttttacaacacatttcttaattcctaacactgccttgcgtatctcgtcagatactttcgaggcgtctgccccttctttcaggctgatgctgattgtccggtaaccgctgactccaaaattcttctccatctgctcatttgtcatgatgatatcaacccggtccctgccgtcatcctctataaatgtatccacctttgccagcggccggcttgctatcgcggctgcatggaagtcagactgtctgtaccaagactcctctgacttaaaacgcagcacttcctgggcagcttctggacttgcaggcgttttcagagtgatcttatcccctgctttgatctcgattccgtcataattcccctgcccgtccatgatggtcttgaatatcatactgttctctgcacgcatcctgtccggatcaatttctccctccagaagatactcgttcagaccttgaaggagctcatcgtcatacccgtatatatttgctttcagcagataatcattctctccgatctgcacagctacgccattgtacttctccatcagtaccggatctggtttgatatccccactgtccgcagtttcgggataataggaattccatttaaatgccccatccaggaatggcacttcccccagcatatacctgactgcgttcatgcttttgattccctgtatctgtttcagatcctgaaccgtccgctcggggatgaccgtccctaatgcatccgaatctacatagatctggatatctgaacccaggccgtcgtcagccttgaaggtcagttcattattaattctggtattttcagatacatatgccgcccccagaaaaagcaggcctcctgcggacagagagaacagaattcccagaaacgccccttttcttgcaaacataaacttttttgttagaacccctgtgagatttgaaagctttatgctgtatatttttcggttctttcttttcttcccgccctctttggcaagcagctccctaagcgtcagtttgtgcattctacgcaccagtatgaaactgatcagaaagattagaataaggaagaataccgctcctcccgcaatgacatcttcggatatataaaatgttccgggggcaggcaggctcacggctgtctgtctggtatctccgctctggtgtacaataaagtcttccggatacacaaaaatctgcccctgggctctatagatcagtgaagcggcagcatttcccaggatacagcccaacggatacccgggcagaaaaatcataaataattctgccgcaagaataccgaatgtactcttctcccccattcccacggtctggagaatgctgtactgggacattcttcggataacagatacctggaacaagctgtacatgataaaaatgctgaacagccccagtgcagccataacgaccttttcggtaagattccagttttcattcagcatgtaccagatataaggcagaccggtccccttcaccgtgacccccgtcttaatcgtattcagcacagacgtgccgccctctccgcccagatacttgagcatttgattatttcttttcaaaccggatttttcaattccaaatgtatctgccattcttgcagcctgcttatacaccttgcgggactcatcaaactttatataaagaaaatctccatttgtcccgtaatcaagatccttgtcaaccagcacttgcatgctgtccgcatccggcatgctggaaatgatgccgcacaaggtaaattcttcattgtccagcttcatccggcttcctatctgcgccggaatatccagatttctgagcgtgtaggtatccattgccacttcattttcctgctgtggatagtgtccctgttccagcctgcggcccatgatatccagataacctgagtctgcatatgccatggtaatctcgtagggctcttccaggactttccggatcgtcagaaccccaaacttctcaactttgtatccctttccctcggtatgcccctgaaattccctgaaccatgggaaatcgcagcgcacataataatgccagtctcctgccttgcctctggcattttcaagcgtggcatttctcccgctccccatcagagagcctataccggtaagtatggacgcagaaagaagaatccccagaaacaaagacagcgtttgttttttgtaatattttaaataggcaaaagccagccggatggtatttttcaatgcatctcaccgccttttgcgtaaaattctctttcgccgtcatacagccgtccgtcctcgatacgtatcagcctgtcacaggtctgagcaagcgcttcgttgtgtgtcaccattaaaattgtctggttatacgttttgctgctggactttaaaagccccatcacttcgatagccgtacgggaatccagattaccggtgggttcatccgccagtatgatggctggtttattcgccagcgccctggcaagggccgccctctgctgctggccgccggacagttcattggggtagctctttctcttctcccaaagtcccagctctttcagcagatcctctatataagcgtgatccatatattttcctttgtcaaaagtgaccggaagagccacgttatcgtatacgttaagcaccggcatcagactgtaattctggaaaacgaatccgatattgcggcgccggaaaatcgtcagctctttccgcttcagctctgctatatcgtggtcccgtatgatcactttcccctttgtaggtatatcaagccctccgatcaggttcagcagggtgcttttcccgctcccgcttgcccccacaattgccgcgaactcgccctgttccgcagagaaactcacgtcggacaacgcccggaccgggatatcccgggagccatataccttatctacatgctgtatgtctaaaatcttcatcccaaacactcctttcctgttcattctgattttatcaggacgtgcttacatacatcctacaaataaaaaagaaattcttacaaaactgtcagaaatcaatttccacagttctgtaagaaaacagaaaagcagcttcccttcccatgctcagaagccacgttcatatatcctttctccttttccagaatcagcttggacagatagaggccaatcccggacccatccatattttccgcatccttgctccggtaaaagcgttgaaaaatctttgtcagctcctctttcgtgattcccatccctgtatcctgaaaccagatctccgaatacatctcataccgcctcatcccgatcgtaatacgccctgactccggcgtatactttacggcattctccagaatattggcaaaaacctctgtagtccatttgggattatgatacaggagacagtccggaaaatattcggtctctatctcaatccccttacgttgtgccttctcgtaaaccagattcaccgcgtcaagcagcgtccggcgtatcagtgccccctccgcctcaaatacaatcacattctgctccagcttcaccatcttaaacagagaattcagaatccactccacctttaccgactgcttcttcatcttaccaaggaaattctcctgttcctcccgtggaagcgatccatcctccagaatttcctcatacatcataatgtttgcaagaggagtcttcagctgatgagacatattggaaatcaaactctttacctgctccttctctctctgggcgctgcccacctcagcctccagtttttcctggatacgcctcgccttccccgcaagcgcagacacctcgccctcactcaaatccgtctgctcaatccttttattatccagaatccggtccatcatccggtcaacttcctggtaaagtctctgtttcttccacttaaaccacagcgctgctccggcgaaaacaagagccagcccgccaaaaatgcccatccacaaccattccatcattctctaccgccctgtttcaatccaccctcatatgcatgatcagtcactcattattatccgatgtactagctctctttccatatgtatcccagcccatgcaccgtcttaatacagccaggggaatcggggttctcctcaatcttagcacgcagcctccgaatattcacagaaaccgtattctcatccacaaaccgtccggaactgtcccagacatattccaaaatctgttccttagacaaaacctgattccggttttccagaaaaaacaacagcagcttatactccaccttactcagcagaacttccccaccatcccgaaaaaccctgcactcccgcagatcaacccgtatcccattagactggacagcctgtcccccatcccgccgcataaccagccgtttcacccttgctttcagaaccgcaactgaaaaaggcttcgtcataaaatcatccacccccagctccagagccatcacctcatccagctccgtatccctggccgtcagcatcaatacaggcacatcactctccgcccgaatctccctgcaaaaatcaaacccacttccatccggcaaattacaatccaaaataacacagtcatacccgcccccagccagcatccgccgcccgtcccggatacaaaccgccaagtccgcgacatacccgtccgccgaaaaagcaaacccaatcccttcccccaaatcaacatcgtcctcaacaatcaacaaacaagccatactcaatccctcacttcacaatcccagcagtcaccaacatccacacaaaaaatccccctgctgaccatatctcattttaatattctatcatagtaaaaaactactgtaaatccattccagcaataccattcccacacgtactcctacaacaaattctcccttactacttatacttccaatccaactaaatccgcctcccccaataatacctaccaatccaacttacttcaccttcccacaaatttccgcacatccaactaaatccgccttgcctcgcaaatgccctcctttccagcccaatcagcctccctcgtttcattcactcccgagaaaaccacgcccttcctcccgcccggatgcgcccagcggttttggcggacagacgggaagcagccttcgggtacacatgccggaaggctgcttcccgtctgtccgccaaaaccgcggatcccttatcccttcataacctccccataagccattctcttctcaactgcctcccccatttttcccatctcagccacgtccccgatcaggataactccgcaaagtctattattaaggaagtaatacttcttatactgttttctccccatatccttaaattccaccgtcttatacacaagattcgggttcttccccgtatctcccaccgcataaagcgcggtattcatcccgttaaatgtaagcgccgccggcacctgctcatactcaacttcttcccctgccgcattggcgcctgccactttcccctgttccacggcttccggccagattgcataattgacgttctggtattgcgcacagtcaccgcatgcatatacatccgccatactggtttccattctgccgttcaccaccacgccgcgatccgtctccagccccatctgttcagccagcccgatattggcgcggactccgctggagatgataaccatatccgcagggatttcctccccgccgttcagccggactgcagttacacgctcttctcccagaatctcctctggctgtacgccggtcctgatattaattccacactctccgccaatatcttttaacaactctcccgctgaagcatccagctgacgccccatcagaacaggcgcgatctccagtaccgtaactctgcactttgccttcttcatctcccaggcggcttccaatcccagtacgccgccgccaatgacaacgacatttttaaccttaggaagaagatcggcaatcttcctcgtatccttcagtctccggatagctacgactgcttccttgtcactgccgggaatcggagggataaagcactccccgcccagagcataaatcagctttgtatatttcaggcgtgttccatcctccagtgatacctctttctcttttgtatccacggaagccacttttttacccagaacctgaacgattctctgttcctgataccatctttcatcctgaatggcaatctgatcctcatctaattccgccatgatagactttgtcagcatgggccggttgtaagagcggtaaggttcatcagaaatcatcacaacggaagccgtcttgtcccggtcacggatggcttttgccgcctgataacccgccgcgccatttcccagaatcagatagaagtcttccgtatcttttcggtaagagctctcctccacttccacgggaacaaagttttccttccccaccccgcagaccgggcagatctccagtgaggcatcgaatatctctccgcagacaaggcattttacaaggccgctctctgcggttttcttctttgtatttggtctgtccagaaggatacacccaaaattatatccaaaatcaaaggcgtcctgtctgtccgcctgatccggtctgaaacgaacctgatacccttccaccacctgcatccgcagctgtttgaggcgctcttctatatggggaacgccttcgccgctccatccgtaactgccgaatacgcctgcaagcttgccgccatgggtaaccggcgtcatagccagcgtcagatcccagatcggtttcagcgcctcccccacaatcgtaggcgtcccgaacagaatcccgtctgcgaatcccagttcctccacggctttgcccgggtctgcctctaccatatcataaaggcggatatcaatatccccgcattcccggatcccttccgcaatgttctctgccagctcttttgtatatccgtaagcactgacataggcgataataacggttttcttctgattaggattgcggacgtcacaccatttctcataccattggtagatctgctccagctttgtatccaaaaccggcccgtgaccggtacatatcatcgtaatatccaactgacgcacccgctccaacgccttgatcatataggacttaaaggggccgatgatacagtcaaaataatacttcgtagccttttcataatcctcccaattctccactctgctcagcagcacatcatgaaatccataatgagagccaaaagaatcacaggttacgaggatctgctcctcctcaatgtaagtgtacatcgtatccggccagtgcaggttcggcacagccataaaatacagagtcttattcccaatccgcatactctgcccgtctttaaccacaattcccgtaaaatcccggttcacgatctctttcaaaaaaccgtttgcagtcccggtagaaataattttcagatgcggacacatatccagaagccgctctacgcttcccgcgtgatccggctccgtatgacttacgaccagataatcaatctcactgaccgtagtcacttcttccagtttttccaggtaatcatcccaaaatttctctttagctgtctcgaacaaaattgtcttatccccggcctttaatacatacgaattgtatgtagttccaaactccgtatacataataatgtcaaatacacgcagggaatcatccacaattccggtccagtaaaatccttctcttaatttcaggcttttcattgcacatctcctttcaggaaacaaatgtctttttcttataataccacagaaatcattttcttaaaccttataacatgatttccggataaacgtttaaaatatgtaacagttcaggcacgctcgaactgtcactaaaatatacttataatctttatgaacttagcaatactaattttactgattttattactgaaaggtgccacactcatgaataaagaatatttaataaaccaaaggccactaaaggcacttcttgtctttgcctttcctattatgatcggaaacctgttccagcagttttatactatggccgattcggtcgtcgtcggacggtttgtcggcgaagatgccctggctgcagtcggggcatcttattcactgaccaatgtattcatttctatcgccatcggcggcggcatcggttcctccgttgttacgagccgactcttcggttcccgggattatacgaagatgaaacgctctatatccaccgcactgctcacatttcttggcctgagcatcctgctgggcgctttcggcttatggcagagcagcgcaatcatgctgtttttgaacacgccgtccaatatcatgggacaggccgcagaatacctgaatatctattttctagggcttccctttttatttatgtacaatgtgctgtcttccatgttcaatgcgctggggcgctcccgtattccgctctacctgttgatattctcctctgtttttaatattcttctggatatctacatggtatattccctggatctcggggtagccggagtcgcatgggctacgcttatagcccagggcatctctgcaatcaccgcctttattctgtttttgagagaactgaaggcataccccgctgcgcctactgtaccgtacggcaaagaggaactgaaggcaatgaccagaatcgcgcttccctctatccttcagcagtccacggtctccatcggcatgatgctggtacagtcggttgtcaacaattttggttccgaaatcctggccggatactccgctgccatgcgcgtcgaggccctgtgcttcgtccccatggccgcaatgggcaatgccatgtccccctacacagcccagaacatcggggcccgccggttcgaccgggtacagaagggctatcacactgcctatgggatcgttgccgtattcgccgtattgctctgcctcacgctgcagttgttttaccgtccgatcatcaccatgtttctcggggaaggcggttctgcactggctttggataccggcatccgctgtctcagatttatgggctggttctatgccctgatcggcctgaaaatgatcacagacggtttgctgcgcggagccggagatatgaaaatgtttaccgttgctaacctggtaaatctgggaatccgggtctgttttgccgccgctatggctcctcttttcggcatttccatggtctggctggcagtccccatcggctggacggctaattatatgatctcatttatggagtaccggacggggaaatggaaaaagctgcatcagcaggaatcggtttcccggacatcaagataagcacattgggaggtttttaccttacccattgtgccagttctttcttatacatctttcagccattcttgtatacatgatacgagcctgattccaggcttctaagcacggatcacatagccagccttcctcggcttcgcctgcccctgttccgccgcatatcccagaatacaatgccccacgccaatataccgttccggatccaggccccagcctgccagaatctctctgccctctttcccgtcaaacacctctctcgcccggtgaatccagcaggatccgattccaagtgaagccgctgcattcagcagattcccaataaccagactgccgtcctcaacgcaggttcccctggatctgtctgccagcacgacaatcaccgtaggagccccgtaaaaaggatcgctttctgtccccataacctccgcattcaaagcagaaagccttcggatcatatccgcatcctgcacaactaccatcaccggagactgcagtcccatcccggtgggcgcatacatccctgcctgtaggatctgttccagaatcttctccggaacctgctctcccgtatacttacgaatactcctgcgttcctccaggcaccgcaatgtttcattcattcaaatcactccttcatacactcctaaacatcacaaatggttccatccccattgtaccatttatatttctgtaatgaaaccctatatgcccgcatagcgagctagtcgttactatgcacggccatagaccgtgaatagtaacccctcatcttaaacgcttctcatatgcgtcagttctcccgataatttgggctagtttaacagacagctgcttcttttacaattttccaacactctttagcagtaaaaagcccggattgccctgcacaaatattccgctgttccgtctccataagccgtatcatagtattgggccatccccttgtccgtctcatacatctctgccaattccaacatcatagcgctcacatcgtccatctgatacaattgtctggaaacaaaatccagctcccctacaatctgttttacttcaaacgtgcttacatcctttccctttaattccgcaagttttttataaagtgtttcgcttcttttctcataggcattaaaaacctcttccggcaggttatcttttacctcgtccattgctttgtctttgctgccataccattcaatcatcttctgataattttgctgcgctttttcggagcccgctctttccagaaacgatgctttaaatatttgactatttcgtaattttcgcatttggatagattctttccatcctgctgtccggaaaatgctcatccaggaagtctccgactgctgacttctccgtttttccggtatttctctccgtgtaccttcccagtgccatacccgaaagcagcatattgacaatcataaatacgatcattacattgcagatcacctttccggcgcgcatgggaatcttttcaatccaccccgaaatcttcggatagattcccttcatccagataacggctgcgatcccccagaagaaacagtacagcagattaatccgcccgcccagattgaatgcaaagtcactgtaatcccagaaaacggttccaaataccaactccgtaaatacactgcagatatactcgtaggccccgcccaggacagttccaaacagaaagatgaagctgtcgcttttctctctgtatttataaagtatcagtgtcagaatcgcacaggccagcccccatacgatgctgaaaggcccatacaccacactgctgcggctcatcagttccccgctcgttatcaggcagaagatggtttccacaatgtctcccagaaatgcgccaataaagaacagggaaaccagcttgtaaaagctgcacccctctgcgaacacttccggcctttccttttcctccgccgttgccgcagcaggctcaatatccggaaatgctttcagcatacggttctgaatccggcgtgtaagtgcattttccagaaattttgaagtcttatgtaattcttccgtgatctggctgatccgcttgtttttcttcagccccagaattgcaattgctgagccgatactgtccactgcaagcaggatcaccgccgtccaaacaagaatcactcccgccagttccggcaccagagatacaacccgtagcagcagcggattgataaaccggagagtcagaactgcacagattccccagagtacggagctttccaggcacacataaccttcgatatggaaacgccgttctgaatagttccaccattttttatgaaaaatcttttccatcagccgcccggtcatatattctatgaaggaggccagtatcagtccgcccaaaaacagaaagaatacgtggttcttcaattccggcaggaaaacggcaaatgcggcagcaccggctccgtatatagggcaaagcgggccgttcacaaatccccggttgataaacttatgttttttaactgctgcaacggcaacctcgccgcaccatcccacaaaggaatagataacgtacagccagagcagttcatatcctgtgtattccatgatttctcccatctttttcagtaaatattttcagcctgcgagacacattgtagcacaaagtcttctgaattacagtggattataaaaaatttatccccaaagagtatgtacagagggtactctttggggatatcaatcatttcaggcgaaagcacctatagtctaacttctatgcctgcagtaagaaacgactgtcaggatggtaaacagcactgtgttcacagctgcagctgccaccatgacacagggcgtccagaacgcctggcttcccagatataaaaaccgggtatccagcagtgcatataaaaagctgtttcccatcccggttcctccggaaggcaggatcgcacaaatccattctgccaggctgccaccccagaaattgctgagaaatatggggaggatacaaaaaatcagcgccgttatggcggaggcaaatacactttttagtctgctggataaaaacagggtaaaaaagattgtggcaagtaatgtcagataccctatcccaataacaagcatctgcagccgtcctaccgtcatttcaacaaaagtaattgcagaaaatgcaaactggatatccgtttgtctggcttcccatccgaatgccgaattgactgttactgtgaaaattgtcatgcagactgcatatattatggtcagaatcgtaaagcatgcgagcagtttcaccgctgcaagacgccgccttccgtgccgggtacagcgcaggatctggtcggattctgtctggtactctaccgaaaatatgggggccgtaattaccactccaactacagccattaaaaacaccataatcccaaaatattctatggcattcgtgtccgtgccgggataataggcaaatggtttctctaccttttcatacatggctgttgctttttccctggcctgcgggtggtccggctgctccatattcatcagatccaccagatgccggctgcactgctcataaaactttcctgcctcttctgccgtcagatccatcgtctctgccgcaattcctgttgtatcatctgcgtacacttcagccagtttactgacaataaacgaaaccggcgctatttttttattgtattcttccaccggcattttttcatcataaaccccattttcatactgtccggcgcattcctgatattgcgccagagctcggacaatcatctccggcgtaatgattcccgaatactccgcctgctctgccttgaccaattttatggcctccagcccttttacctttaccttattcccggcctcatcctgatacgtatatcttacaaagctgatcggagcatacgcaagaagggcagtcagcacaatggctcccaatatcacgatcagcacagacctcgttttcagaattcgctttagttccatcagataaagtctcatatcagcattcctcctttcccgattcctcctgcgggaaaagccacagatacaaatcttccagtctcggacgggccttcactgactccgggaaaaccggcttttcagacagataacggacggaaaccgaatcgctgttatcattgcgcaggtttacgattctggccttctgctctgcacggtgcacatcatagggcgggatctgtgcattccagacctttccttccatcatccccaccagctcttccgtggtgcctgttgccacaatatgccctcctttcattaccgcattctggaaggcgatatattccacatccggtacgatatgtgtagagatcagcacgatcctgttctgagcaaattcagagagcagattgcggaaacgcactctttcccccggatccaggccgcttgtgggttcatccagtatgagaatttccggttcatttaaaagagcctgggcaatgcccaccctccgcttcattcctccggacagctttacgatctttttattttgtacatcttccagcgtaagcgtttccatcagttctgcgatcttccgtcttgtctccttacgtgtcagcccttttagcactgcgacatattccagataatcttttacggtaaattccgggtaaaaaccaaattcctggggcagatagccaaaaatattccggtaggcttcccccagcgcgccaatttcaatatcgtcatacttcacacagccggatgtaggcctcatgatccccgcgatcattctcatcagcgtcgtcttacctgccccgtttgcgccaagcagcccccagatccccggagtaattgtcagactgacatcctctacggctgtcttatccttatatttttttgtaaggttttctattttcagttccatttctgctcctttcatttccgttgcctactttgctgctcaatggattcaacaggatgccggtccatccgcaaagctgttcgtcttccagatccgcctgagctgatatgcacagactgcaaggcagaatatacatgccgtccaccccacagccgccggcagatccgccagactccctgtcccggtccggtccattataaaaatgagggcaagaatgcatactaccgccgcgttgcagctctttacataagactgaatcctgatatgtccgagcagaccgatgcagagaccgctcacagccagaaatggcagcaggctcgaaaaaacaatctcccggaaatggtatacattttctgctgccgtcaggcccatcattcccccgatcagtacaacagcccccgcttccgtaatcagcagcctggccgccatcagccgtcctgcggagaacagcgaggcactctcgatctctgacatccggtaacggatacttcttcccatcatcggaactgccatccacgccagcatcacagccatcgcaaatagaagatagggcagatgcctggaggccgcttccatattccctaaaatagtatgaagagcacaaaacattccaaccagcgccagcaactgtaaacaccatattttccagccgataaatctgacctggcgcagaaccagttcaccaaatccgatccttctggtcctggacaggctgttctgcctgcttgtataaatagttttcaccataccggccgttttttccaaatgtttttcacaaatctccggttgtttttcccggaactcttttctaagctccgttataaatgcatcatttttcatctccatcaccccgccattcctgcatattttgcaatgttccctctttgtcctgccctgcagcagccgtctttttcagccttttcagtgcataacgaagctttgactgtaccgttctgactggcagcccggtaatctccgcaatttcccgcagtttcatctcctgtccataacgcagaaagaccagttccgacatttcttctggaagctgcctgacaagcctcaaaaagtccgtatcgtcctctgtctcctggaaggagggatccgccaaaggcactgcctccaacacctcggcctccacgggcacctcacatttgctacggctcatatcaatgcatgtattcgcagcaatccgatagagaaatgcacggaatctgccccggtgggcatacctgtccatatagcggacagccttcagaaatgtctcctgcaccgcatcctctgcatttgcctggttagaggtatgccagcagcaataccggtatatttccggataatacataccgaccagctcatccagcccctccatattcccctgttctatttgtttaaaaatttcattttcgcgcgtcaatttttcctcctcagggcgtcccctactaataataacggatgggattcctgaaatgatttaaattttctaaattaaaataaatattttttaagagacagccaaatcgtagattctgccgcctaagccgagtatacattccgctttcccgccgcctgtaatctttcatatcctcccatatctcctgcggtctgtcaacttggtgtatcagacagacaaaaaagcagacaaaaagaaggcatatccctggttaaacatgataaccggggtatgcctttttttatctgttactttctttatttttcaatttcctgcagttaaagaatcattcccatcttcttcagcctgctgcgtattccgccctctgagcggtgatgcacttcactgatctccttaatcttcataccggattggtactcttccttcagccgctcttcctcttcttcggtccatgccgcgtacgcctgcacaacgccctgtgagaccaggctgtccctgtatgcctcaaatccgtctttgatggttactttctttttacccgtcttttcgtccagttcctcttccggctctgtctttggctctacttcctccgcccggatccctttttcttccatatatgccttaaccatggccataaattcttcgccgtacttttcatatttatttgttccgaccccgttaatctcaagcatggccgccttattagaaggaagataagtactcatctctttcagcgtcctgtccgagaaaatgatatacggcggcacatggttctcctgtgctatctcataccgtttctgacgaagtcgttcaaacagatccggatatttcacgtcaaccactttctgcttcttttccgccttctgctttgcaggtgctttttccacttctttgggaagtttgaggatcaccggttccggagtctcctcccagaccagattccttcccatttctgtcattttcaaaaccgggtattcattcgtggtcaggaacagatagcccttcaccagcaggtcattcataatctgccggatgcggatcagcgtaacttttttcagcgtaccgtaataaggatttctgtccagcctgaactggcgtacttttgcattttcagatccatgaaccgcatcgataatcgcgttgatgccataccgttctccgcttgtcctgaccaggttgatcagactgactgcctcctgcgtcacatcaatatcctgaaattccatcaggcagttctcacaatttccgcaataattaccgccgtattctccaaaatagcgcagaatataatcgcgcagacactcatttgtaaaacagtaaaaggtcattttcctgagccgctcattgtcccgctcccgtatcagttcccgctcttcataatccagatcttcgttctctgtctgcctgccgatcaaaaattcattgatcttcacatcctgcccggaatacagaagtatgcactccgacggctccccgtcacgcccggcacgcccagcctcctgatagtagctttcaatatccttgggcatattgtaatggatgacaaaccgcacattggacttgtcaatccccataccaaacgcattcgtcgccaccatgatcggtttaatatcatagataaaatcttcctgattttgttttctcgcggaatccgacaggcctgcgtggtactttgccgtcatgtagccttcccgaagcagggcttcgtggacctcttctacattttttctggtgttgcagtagataattccgctcttatccccattcttctgaagatacgacagcagctccgccatcttatttttaggctttttcaccgcaaaatagaggttctttctgtcataccccgtaaccatgaccgtcggttcctgcagtcccagaatacagacaatatcctccttaactaccttggtggcagttgccgtataggccgcaataaccggtcttttcggcagcatattgatgaaatccacgatcttgagatagctgggcctgaagtcctgcccccattgggatatacagtgcgcctcatccacagccaccatggaaatatttacacagctgaccagcgataaaaaggactccgtcagcaatcgctccggcgccacatatatgatcttgtacctgccgtttctggcattgtccatcgcttttctgtattgaacctccgtcagggaactattaatgaaagcggcgtgaatccccagctggttcagcgccgtcacctgatccttcataagagagatcaggggggatatgatgagggaaatcccctcaaacaataacgccgggacctggtaacagatcgacttgccggccccggtcggcatgatccccaggacgtctcttccctgcagtgtgctttcaaccagttcctcctgtccgtcacgaaatgaatcgtatccgaacacttctttcaaaactttatatttatccattcatttcctcttcctgtaaattgatgccattggctattacataatctgtcagatgttccttctgtcgaattcttcccgcagccataaagcatcgtctattgtattcttccagccgtcccgttttaaatcaacccgccagccgtcttctgtccagagtacctccacgccctcgttttgcagcatctgcttctgtaaatccggcgtggcaaatgccgcggctccgcttaatatccctctcgcgttcaccacacggtgagccggcgcatcctcccccgcgagcccgcggctcaaggcatacccaacctgcctggcatgcttcggttttccgcacagcagcgcgatctgcccatatgtagaaacttttccttccggaatgattgagcataccaaagccgttcttttataaaaatccataatcacacccgctactgcctttaatcttgttaaaatccctttagcttttagtatatatcactccttgtgaaactgcaatatcgggatttgaggacgaatctcggcgtagatggggtgcgccaagcgaactggaagcggctattcgtgttgcgcatcatgctaaaatagactttgaagtttttatgtatgggatctttggaatgtttacggatgaaactaggaaattcaaacctattttctaaaatttttttatacaatctgaagagcttcgatagatattgggacttctgtttgatataatgatataatatgaagcatagatgaacgaagttgtgtcttcctggcggtataattccgctatgctgtgaaataagttctacataacaaacaaattacaaaaaggaagcgattgcattgcacagtaatacatctcaggatgaaaaataccggatgatgacggaggcgcccatccccggattgattggccggctggctgttccaacgattatcagtatgctgattacctcattttataatatggccgatacattttttgtcggccggatcggcaccagtgcgacagcggcggtaggggtagcatttccactcatggctgtgattcaggcgctgggctttttttgcggacacgggtcggggaattctatttccagaaggcttggttctaaagatgcggatgcagcggggcagctggcggccacgggatttttcctggctctgttcctcggttttgcagtaatggcactgggactgatttttctgaaaccgctctgcattgtacttggttctacgaaaacgattctgccttacacggagcagtaccttgggatcatactgattggcgccccctatatgactgcacagcttgtattgaataaccagatccgttttcagggaaatgctttttattccatggtcgggattaccatcggggcggtcctcaatatcgcgctggacccgctttttatctttgtctttcacatggggatctcgggagccgccattgccacgatactcagccagttcgtcagttttattctcctgctggccggcatccggatctctgggtgtatccccatccggttccgcagcgtccggttccgaaaagaacggctgcgggagatcctgggcggcgggctgccgtcgcttttccggcagggactgggcagtgtcgctaccatgacgcttaatattgccgcgaatccctatggggatgccgcgattgccgccatgtccattgtgagcaggattaccatgtttgccagttcggctctgatcgggttcggacagggattccagccggtctgcggatttaactatggcgctaaaaaatatggccgtgtcagggatgctttctggttctgtgtgaaggtctccaccgtggccctgttcatcctggcggtcaccggtgcgctgctgtccggccatctggtcggcattttccgaaatgattcggaagtcatccggatcggaacgacggcgcttcggttccaatgcctgacttttatactgaacggatggattattatgaataacatgatgatgcagaccatggggaagactggatatgcttccgtgcttgcctccgcccggcaggggcttttcttcatcccggcactgctgattctgccccggctcttcggcctgtttggcatccagatggcgcaggcagtggctgatgcatgtacctttgtcatcacaacagtcttgtaccgcattgtgatgaagcagatgcgtggtgaggaattagtaagcaaaactgaccgttaataacagcaagttaatgattattcgaggtactcgcctgaatacatcaattcttcgagatattttatatgcttctgagaaaggaggaacttcttatgatactctgcattgacagaactccatgcaaggtctgatacggacgaaactgcatggagataagaataggaagcgtttcatctctgcactgtttgactgatgcactggtgcagcagcgcttgactatttttcgtccaaccggactttgcatttttaatatgacgatttcagtgaattattaaaaaggagcaaagtcaaatgaaaaactttaaaaaattatttcagggattacactcattcatccttctgtgggcaacccagtcattttcagaactggggagttccatgaccagttatgcgcttgttatctgggcttaccagcagaccggatccgcgcttacatccgctctgctgacggtgtgttcttatgccccctacgtgctgctgagcatctttgcaggcgctttgagcgacagatgggataagaagcgcaccatgctggtatgtgacagtctcgcggcagtcagcaccttacttgttttctttctgcttgggacggggcgcctggaaatctggcatttgtatctgatcaatggttttaacggattgatgaacaccatccagcagccttcctcggacgtagcggtcagcctgctcacgccaaaggaacagtatcagcgggccggggggatgcgttcattctccaattccctgatcacaatcctgtccccggtcattgccaccgccattttttcgcttttcggaatgacggctgttattgtctttgattttctgacgttcgggactgcttttattacactggcattttttattcatattcctgccgttaaggtatccgccgggaaaacgcaggaatcagtcctgaaagccgcggggaaaggacttcaatatctggcccggaatcaagggatcttttacctgattctttttctttcagccatcaacctgaccgcctccatgtacaacgcggcgctcccggcaatgcttttgtcacgtaatgggggaagcgaggccgcccttgggctggtcaatgcctgctccggaattgcaaatgtagcgggaagcctgattgcttcttttgcttcgaaaccaaaaagccgggtaagggtgattaccaattctctgcttttttccatgagcacagagaattttttgctggcactgggacacagtacacccgtatggtgcctgggcgcactgcttggatggctgttcatcccgattatgaatacgaatatggacgtactgcttcgcacccacatccctgtggagctccagggacgggtatatgccatccgcaatacctttcagttctttaccattccgattggatattttctgggggggatctgcgtagataaggtgtttgaaccatacatgagccagaaggcggctgacagcctgccggggcttttattcggcaccgggaagggaagcggtgccgcaatgctgtttttaatactgggatttatcggtgtgataacctgtctcatatttcggaaaaacaaacacatctgggcgcttgaagaatagccggctgtgcggattttaaatcagaaaatgcctctcctgattcagcatcagggagaggcattttccacttcgtcatcgttcgtacgtccgctggaaaacgtaaaaggcttttccaggtagtacctgtttgttaatcagacagacctgcagccttctaccgtgatttggggcatctggaaataagtcgtaaagccgagcttcaggatatccccaaactctatttgctcgggcggcagatagacatgtcccagttcactgggtacctttttgtatccattttcttcgagtttctcatccttgccggcaaaccttgccagcacctccacataggagccgcctcatgtgctgcacgcgccaaggaacagcacgaggtctttctgacccttttcgttcatgtattctttcagattattactcattataaccttcataacatgacctccttttctttaatgttatcattgtacaccatctgtctggaaaaatctgtgattaagtcacataaaaggggtctgacccctttgccctccgttttcagaatattctgaatttatctctggggcattttgaattctttcagcgcctgatttaaatattcattgaatggagccataagccgaaatcgttcagccgcaaactggatgaaagtatccttgttctctagtctctcatcattaaagttgtcttcaatataccagcttttgttttttaagtactgcgccatagggtgttcggcgttgtacccttttgggacgttttttaacgcactgcctttgattgcaaaacctgccttgctgtctttgaattgaggggattccacgatctcccgcagctctgctccgtggccgtttatatagtctcttaccatggctgtggcatcccggaacatgtcagcaaataatccgccccctagaaatgatcggtctcccgggcggatacacaggaaatatccgaccggcacgggcagcttgccggcaggggatatatggcatcgaaaagccggattgtacggggacttgtcattgctgaacctggtgtccctcatcagcttaaatgtaagttccttgggctggaagttcaggattctggcatcatctttgccaagcttagccatcaatccggcgatgatctcttcaaactccccgaacgcctcctggtactccgccttatgggaatgaaaccactcgcggttattgttctgttctaatttactaagataagtaattatttttgacatggtgcgcctcctaatattcctgaatctttttcatctgagaagaattcaataccattaccattctttcctttatcgtctccggggtctggtacatcggaagttcgtcaaatacaagcgaaagctcgtccagcttttccatctcgtctttgtactcttccagcaccttgtcttcaaggggatggagcttgagatactccaggcgctccgggctgattctcttctgccggaccgcatattccacccgtttcctgcaggtgcacattcccacgccggacagcccgcagtattctgcaagaaatgcggctaccttcccgcggattctggaaagtttctgccggaaattctctggagacatctgcaggatctcccccgcggtacgactgttgattcgaaacattgtgcccagaataaaaatacatcggctctctgcatcgagacattgcagcatcacattggtacaggacaatttcagttcctccgccatctgctgcctgctctcctcctcaatcaacccctccgtctcatccaaaaccgcgtatttgatatcatttccataaaattcaaaatccagcggctggtgcgcaaacatggactttttataattcagcagataattcacagtaatccggtacacccatgtttgaaaatcgctttccctccgaaatgtccccagattcgtcataacacgtaccagtatctcctgggctgcatcctccgcatccgggattgtccccaacatcctcagagacagattaaataccatatcctgaattccggccagaagttcctccagcgcatctgcattcccaccgactgcagattctataagcacatttttgttatcgtttgcttccttcatcttatccttctcctaactgtgtattttttcttactttaaattagacaccaatcgcttcatggtgtgacagatattctcaaacttttagcataataaatatattatatcatctttcatgaattcatcttccgtatcccatttgtattttggttatttacacacgatccattccctgcacttcttaattataatcaaggcagcagcaattccactctatctatcatcaaatgtctttatataaatctgggaatctcttcttttttttatttcttcagactctttttcttcttcatcaagttcttgaacctgcgcatcacctgtacctgaaagagcttcaagcatcttggctatctcattcatggctatgggacctgaacccaaggacaggatcaccattagggtgataaaaaacttatatatctttttcttcattatattcctccaatccaatctctgcttcgctctaataataggtatgcggtttatacccgctatctatttgcatacaaaaaagaagccattgtctgattctataaatgacttataaccaccagcacacttgcaataaaggattcgtatggtcgtatatatttatgctttggccatgatttgggaaggaattgattcaattgtccagacgtaccttatgattaattaatgtccatttatcaggcaataatataaatagggtcaaaaagaaaaaaagaaaaactataataagaaaaagaagcaggcccattgcttttgggatagctgtaatcatgagtattgagcatctattctttgttatagtttcattactagaattatttttgttcaaaaataaagtcctaaaacaggcagtattattaccgtcttcattggtaacgatactttctgaaattttccacgtctcagaaacagttgtcttatctaatagttcatatagattgtaagcactacaaaaaagcgcattcacagttatgcacacagcaaaaagaaacatgatgaaaaagactctaatacgagatagctgatttttctttatatttaataccattcctgttcccttcttagctgccgctgcgactaatgtggttaacttaagctgcattgcttttgattccatatcttgaaatgttggaaaattttaatttatttaattataccagagtaaaatgaaaaaatgaagcgctgtatatttatactacgaatagacattgcgttctgaacagtagccttgttattataaaagactttgtctactgtatgaacagttccggcagccccgaactgttcagccagctatggcctaatatccgcacggccgctcccccttgacttttcattaagaaatgatatactaaaaaacaggtttatcaataccgttaacgcgaagacaggaagagtaagctgaacagccacacatagaaaaatgcatctgctgaaagtccatttcatgggacatcatccgaaaaccaccctggagcggctttaatacagcccggccgacaccgttaccgtctaatgaatggcacttgcaaaaagggtggaaccgcggtatcatagtctatcgtccctgaacagttttcagattgttcaggggctttattttttaaggaggagaaaacaaatgaaagttacactgaaagatggatctgtaaaagaatacccagaaagcaaatccgtcattgatattgcttttgatatcagtgaggggctggcaagagcggcatgtgcgggagaagtggacggagaggtcgttgacctcagaacaattattgaaaatgactgcactttgaatatcctgaccgcccgtgatgaggcagggctccgggttgtgcgccacacctgctcccacgtattggccgaggccgtaaaaaatctatatccagatgcaaagctggcaatcgggcctgcaatcgacacgggatattattatgattttgattctgcgccgttctccagggaagatctggataaaatagaaaaagaaatgaagaaaatcattaaaaagggcgccaaattggagcgttttacacttccaagagaggaagccatctcttttatggaagaaaaaggtgagccgtataaggcagaactgatccgtgatctccctgaagattccaccatctcattctacagacagggagagtttgtggatctgtgcgcaggcccgcacctgatgagcacaaagggaatcaaagcatttaaactgacttcctcttccggcgcatactggagaggcgactccaataaagccatgctgcagaggatctatgggagcgcttttgccacaaaggacgagctgaacgagtatcttcagtacctggaggaagtgaaaaaacgcgatcacaacaagctgggccgcgagatggagctgtttacgacagtagatgtcatcggccagggactccccctgctgatgccaaagggcgctaaaatcatccagacactccagagatggattgaggatgaggaggacaataactggggctatatccgcacaaagacgccgttgatggccaaaagcgacctgtatcagatttctggtcattgggaccactataaagacggcatgttcgtgcttggagatgaggagaaggataaggaagtctttgccctgagacccatgacctgcccgttccagtactatgtatacaaggcgagccagaagtcctaccgcgatcttccgctccgctacagtgagacctcgaccctgttccgcaatgaggagtccggggagatgcacggcctgacccgtgtccgccaattcacaatctccgaggggcatctgatcgtccgcccggaccagatggtagaagaatttaagggctgcctggccctggctaaacaatgcctgaccaccctgggccttcaggatgacgtcacttaccacctgtccaaatgggatccgaataacacggaaaaatacattggagatgcaaaagtctgggaagaaaccgagggccacatccgcaatatcctgaccgagctggacgtaccattcgtggaggatgagggggaggccgcattctacggccccaaagtcgatattaatgccaaaaatgtatacggcaaggaagataccatgatcacaatccagtgggatgcactgcttgccgaacagtttgatatgtactacattgaccagaacggcgataaagtacgcccctatatcatccacagaacctccatcggctgctacgaaaggaccctcgcctggctgatcgaaaaatatgccggcatgttccctacctggctttgcccggaacaggttcgtatcctccctgtctccgataaataccttgattatgcaggcaaagtggagaaagagcttaaggcaaatcatatcctcgccacggttgacggccgttccgaaaagatcgggtacaaaatccgtgaggcaaggcttgccaagatcccttatatgctgattgtcggggaaaaggaagaagcggaaggcaccgtatccgtaagaagccgtttccttggagatgaaggcgcgaaaggcctttcggaatttatcgacgcagtctgccgggaaatcagaacaaaagaaatccgtaaaattgaagtgcaggaacagaaataattgctgctatttgagatacgccggcaacttgcataaacactgagttttgcaggccgccggcgtttcttttatgcccgtaagcgggtaaaaaaatagctctcaccgcatagtaagcacagacgcattaagaagaaggatacaacgccagaaaatacagatttttatctgtgattacagaagcaggtcattcaaacacattatgcggctccctttactttcataatagcgcagcatttcgtcgatttttcttttatcataactggtaatacaatctgaaagaacagcaacgccgtaattcgctttgcataaattgtagcaggtcgatttcacgcaggcagcagcatctgcccctgctatatagaaatcacatatttcattcttacgaataaagtctgaaaattcttcactggttaatgcgtttcccttgtattttgtaaaaatattatttgatactattttcaagtctgaagctaattccgccccatgcgtattgggtttgaaagtcctcgtgcctgctgatagattttcatgcctgatataaaccacatgaatattatgattgtctgcccaatcgacagcttgattgatattgtctataatatctttgtaattttttgtgatgtcattttgaatatcaatgattactaaggcttttttctgcatagtgtctcctcctgacaggtaaattaatttgtttgctttattatgataacatctaattgttgacaacattatggcaacaatctatattaaaaaaagaagttgttgagtaacagttcaggcctgcccgaactgttacgttttgaaaggtggttctcacatgaaagttgacaggcttattagtattattatgatactccttgacaaagagcgggtaggcgcacaggagttagcagatatatttgaagtttctccccgcacaatctatcgggacatagacgcgatcaatatggcaggtattcctgtccgcggggcatcgggagtcggcggcggctttgaaatcatgcagaattacaaggtggataaaaaggtgttttcgactactgacctttccgctatcttaatgggactttccagtctttccaatatgatgagaggcagtgaactgataaatgcccttgcgaaagtcaagagctttatccccgccgaccaggcgaaagacatagaattaaaggcaaatcaaatatatatagacttaagtccgtggatgggcagcataaacatacaaccctatttagaaataatcaaaacagctctacaggaaagcaaactggtttcatttgactatgcagaccgctacggcaataaaaccgcaagaacagccgaaccatatcagcttgtattgaaaagcagtcattggtatttgcaggggtattgccataaaagaaatgcttttcgcttattcagactatcccgtatatcaaatctgcaaatgaacgaggaaactttcacacctcgggaatatcaaaaaccgcagttagattttgctgatattttggcatctatgcagaccaaaatcaaaattcgtattcatagctctgtcatggacagggtacttgattattgcacttatgaagacttatcgccggacggtaatgaacattacattgttaattttcctttcatagagaacgaatattactacaatgttcttctcagttttggagacaaatgcgagtgtttagagccgttacatatccgtacagaaatgaagcgcagattatataatatcgctgccatatacgagaattaatacacaaagaaagacaaaaaaagcccgccaaaactatatcactcagtctggcgggccattttaatgcagtccagttcatcttatataaatctttgttgattacattttaaaatgattataaaaatccttcagatcctcttttacatccggaggcagctgtgcctttttgatcccccgtattgcgccctccagcgaatacagacggtggatacaggcggatgaatcgatctcctgtattttcagccaggcctgtttacttcccatcgccctgagctgatcaaacgtagtaatgccggcctcccgaagctgttcttccaccaccgtgcctatattgggcagtttcgataattctcccatcatcccttacctcctgtcattcgaatattatacttattatacatcaaacagacaaggtgcgccagccatttctatctgataaccgttacttcatcggcttcgagaccatgcagctaagactcctcagccagtctccggtaaacatatataaaaactaccgttaaaataccgagattcactaaaacagtcccccaggcctttgctgtgccgccatcgtccgttccgctgataatcaagtaaatctgctgtgaataaaaaacggcagctattttcttaattgtatcgttaaacgcagacagcattggtaagaaagagagcaccatcataaccggcactgtcagggaggttgcactcatctggcttttacatgcagttccgataattgcaccgatcagaacggacaggattattcccgtcatcattacgccgcagaacttcaaaaatgccatgccggaaagtccagccgtcaaaccgaagcacaccgtgcctgccagacacgccagcaggacgcacccgcccactgcggccagatactgaggcattctgacatttgccatcagcagcgcctttaatgtatgtttttccttttcttctgccagaacctccgtcgtagcaataagcggcgccattccaatatacatggacgcaaacatataaacaaaataatttctcggcaagcccggcatcttcactgcaaacgtcataataaccgctaatacaggaaacatgacaaactggatcagtacatttttatttttcagggtatccttccattgttttttcagaatcgcggttacatttctcatatctgcctcctaatatatcgtacagacctccctgcagcgcttcttcaatatcagtttttgcaaggtgactgcctgtttcagcctttcaccaggcttcttcctgtcagtttcataaatacagtttccagatccggctctgttgaatggatgctctctacctctccctgccggaaggaggatgatatcgtgtcagcagcctctggagaattgggcagagtcagcatctctccgtttttaaataaaatttgaatctgattcaattcattatacttgcggcacaacgcgtccggttcaccgtattccacaatctttccctgatggatcagcgcgatatggtcacacagctttgccgcctcctccatattatgagtagtcagaaatatggtagcgccattttctttctgctcacgaatcagcccgtgtatttccgccgtcatggccggatccagggcaccggtcggttcatccatgaataacagctttggttcctgcagaatcgccctggcgaagaccagacgctggcgcatccccttggacaggctggacgcagccgtacggccttctccgtccaggcctacctggcgcagtacttcccgaatccggcttttcggaatcccgtggatatcagtaaacagcttcaaattgtcgtaacagctcaatctttcataaacacctgaatcatccagcatagcccccatctggctgtagattttggtccgctcagtaaccggcagccccagtacccggatcttcccccggtccgcctttaactgaccggtaattaacttaatcagcgtcgttttcccagctccggaaggccccagcaggccaaagacttcccccttatggatctctatagagatctctctaagcacttgcttttcgtaaaatgatttgctgacccctctgatactaatcgcgttttccatcctgatcctccttccacctttccttcagatgctccaggctttcctccagtttttcattttccatccggttcttaacagacataatccagacactggccccaaaacatattgcaaagcataaaacaaacatcacccaggcctgccacatatgaaccgggaaccatcgaaacagaataataaaaagtacaattaccaagacagaacaaagcagcatcaggcagatccggtacaattccggcatatattttgccgccctttctgaaaagaaaagaaaccttatcccggtgatcagtacggctaatcccagatactggcacatcgtagccagcgcaatccctctcccgcccagcctgaacatcgtggaaagagtgcgggtctcttctccgaaagcaaaagtaaagatcagcatcaggatcatcataaacccaaatgtacaaagtacattttccgcaaagtcaaaaaaattctttttttcttccatttatttcacccccagtttctttcgcacatagtccgcatactgcctggacacggtcagctgctccccgtttgtcatcgttacccgcagcttcctgtccagatccgcacggatcttctggatttgccgcagattaataatgcaggactttcctgcccgaaaaaaatcgaactctttcagttcctcctcaagctcatacaattttaagcaagattcaaaaacatcgtccttggtatacaaaaaagttttcttatctgccgtgtcaatataaaggatcttagaaatgtccagtatatgcgcttctccgtccttctctcccagcagcttaaaatctaaaatgcgcaggatcgaaatcacccgctccagctgcggagtcaaatgccggcaggtaatctgtatctcagtctcatcaatctggctgtccgtatgaatcgagattttcaaaaagccctccccctttcaatttctgtattaactatacttgctcaaagttggaaaaacaatccccataaactaacctgcccaaataaggggctgagtttccatgtggggaagatgaaagtgaggacgcctggcgtgggacgggacgcagacggaagcatctttctgttggggattctgaccgctgtgctaaacagcagtaaaagaagacacacaaaatcagccggcaaaaattgaactataatcaacttttgccggctgattttgtgtgtcacctcttactattcttgaatttgcagaccaagaaaggatcccactcctcatccgtttcatcgtcaactcattctctaatgtatgactcaataccgtttgctatcccttcagccattttttgctgaaattccggatctgccatctgcatatcatcctgctggttggtcataaatcccatctcaaggattataaccggaacctggctccaattgattccggtcatggtatcgtctgtctgaacgcctctgttataaataccggtggctgcgcagtatgaattcaggactttctctgcgagccggaaactctcctcgtacaggcctcccgcataaggattatccggtgacataaccagacacagggcaccggcactctctggactctcactgccgtttgcatgaatccttacacaaagttctgctccggattcatttgcaatctttgcacggtcctggttgctgaccgatgtttcatggttttcgcgggtcatcaccacctggaaaccacgttcagccaaacacgcttttacctgcttggctatatccaggttgagctgatattcggcaagtccggtaaaacggcctgcagtgcctgatgttgtcttcgccttcatgataccggagcccggtccgtcctcttcttctcccatcattcccgcatccggtccctgatggcctggatccagcgctatgatgatctggtcctctgttttctcaggttctgttgcaggatctggttcctgagtgtccgattttacaggatctgatttcttggtatttgattcttcagtatttgattcctccgtgtatgattccgctaagccagctttgggagtgtctccgttattaagtttctcagcaccggctttcggagtttctgtctgtgatgaagcctgccggctgacctgatcggccattacctgctttcctgctgcccgttccggcttcctggccgaatagataaagactccggccgcagccactgctaacacaacggctattcccgctattcctctgattttcttcttgtccataattctccttttcagccgcattcccggcactattacaaatatgagatattatatgccctgcttgtccaaattatgaacaaaagaaagttttaagacaccctttttgagtgtttatccgctgtccggttttatagaaaatcgaacagactcatctgtttcccactgtccgcatttttacgtttgtctgcccgctcccggcagatttcctcctcaggcagttccgcgagaaatccggattcttcctgggaagttgtcagtatcagttcgtctttcgcccttgtcataccaacatagaaaagcctgcgctcctcttctgtatcaacagtatcgtctttttcaaaggggataagcccttttctgacaccatagatgaatgttacaggaaactccagtccttttgccccgtgaagcgtcataagcgtgaccgcctcgcctgtatagcgcttgtcaccgcagcgttttaaatcgctctccacacccatgctcagcgcctccataaattcatccatatttttatagaacaccgtcatgcccgcaagttttttcatcgcactgctatcctgcatctgcatttcttctatccatttctccaggaacttctgagttctgctttttgcatagaggggtctgaacttttctgccattgcctgaaatacgccttctgccaccacattgatttccatatcccataacagcttcagggatattttcttagaaaactcatccgccggattcgccaggcatttgaagaaggatatgctccctcttacttcatcctcagccagaaatgcttctcttcccgctgtaacatatgggattccttcttttctgaggcatctctccaacaggtcagcctgccggtgtgtgcggtagagcacggcgatgtcaccgaatccccgttcttttccgcttccggcgccaatctcctgggcttccagcatgccgattccgcctgtaagcctattgatctcctttgctgtaaatatggcctctgccatctcgcttgctgcttttactacgcgtaccggcatttcttcctgcctgtggggcaaaagccgtctctccggtcccggattgtgtgaaataacagacgcagccgcatgaagtacggaaggtatacagcggtagttccatgcaagccggatctcctgcatatccggataatcctgtttcagcttttcaaaacaacgcgcatccgatccacggaaaccatagatggactgatccggatccccaattacaaacagctcccttccgcctttgttccaagcctgaataagacggtactgtatgggactgatatcctgaaattcatcgacaagcagataggaaaaccctttttcccatccttcctgcgcgactccctgttccattcgctttaatgtctccagaagcaggtcgtcaaaatccaacagcttctgttcctgaagaatcctctggtacgcatccgctccttcctgccagttcagaggcatatccgtctcctcttcatccgcaccgttttgcaccagcctggtctgcatctcttcgggggacattcccgatttgagaagggaaaccacccggagcagttcttttggcttcatcttcagcccggtttcgtccaatgcccttcctgccgcctccattgaggccgcatcatccgccagtgaaaattcgatcccctgttttttcaggaaattcaggcagatcgcgtggaaagtccctacctgcattttgttcagatttctggttctgccaatcgcctttttgattctttccatcagctcccctgccgccttatttgtaaatgtaaccgcagtaatttcagaaggctttacctttcgcacctccagcatatgtaaaatccttgatatcagagtctttgtttttccggtacctggcccggcaaccacggcaattgcgctgcccacggcacgaactgcctgttcctgttccgggttgagccccgccgattggttctggctgtccgcttcccctacagttttctcaccgtctgccatgctctctggtacaacattttccgcccctgtttccgctgcagtctccttgccgtcaccggacatctgtggcttatcagcctgattcccctcttcgttgatgcgtttctctaccgtctctgctgcctggatacaaagggcatcaaagaaactcatttgcccatccaaacggtcgatctcgtcctgcgtaaataattgaattgtcccatactctccatcaaatcccggattgcgctctaccttcccatctctcagtcttcggattccttccgcaatcagatgacccgatatttttttcacttcttcctcaggaaccgtccgcagtatttcgaactccggtcccaatgtacgcagcatattctgatactccttctgtacttttgtactcgccgcagagtgccccagggatgctccaatcacttccggcagaggcaccaggctctcaaaacctttcgccccagtccgaacatagccttcttcgcggtcagccagctgttctacccgatgcgacactccgattgtcagctttcggccgcatacggggcagacgcccccatattttatcgtctccgcgggcgtcaggcagatgccgcattttcggtggccgtcgtaatggtattttccttcttcggggaaaaactcaatcgttccatgcaggccttttccggtctgtatggcctccctgagttctgtaaacgaaagcccgatatccagcagattagcttcacggcccaatttagccggggaatgcgcatctgagttggaaatcagctgatactgatccagcgcagaaatccgccagttcatcggcgggtcagaggacaggccggtctccatagcatggatatgtcctgctaaatccccaaagcactcctccaccgaatcgaatcctgagaaagcaccgaaaagggaaaaatgaggtgtccagatatgagcgggcacataaattgcaccgggacacaactccaacataatttccagcagatcatgacagtccagccccaggatcggccgcccgtctgaatggatatttccaatgatctccagctttcttgccagtatctccgcgtcctccaggcccggcagcaaaatcaggctgtgtaccttccggactctgtcgtacttcttatagatagaactgatttctcctgtgattacaaaccttgggatcatcacatccgctacagagccgtctgatatgcggtattcttctttcaaagtgtaaagcccttcttccgccggctggagcttttccagcatttcttcccgccaggccggatgggtaaaatcaccggttccgacaatgtgaattccctttcgtctcgcccataagtccaggttttccagattacagtccctgctggttgcacgggaataatgggaatggatatgcaaatctgctatgtacatataaacaccttctcttctgaatactttatgaaattacttgtccgcttttgtatctttgccgttcattataacatgtgatatcgtcggaaatccagtctatcgcatcatgccatgtatagaatatggtcctgcccttcctcctcatcagctgagaaaaatacgtgcttattatggccgcctggccccggcttccgggagggggcattactggtactattggaaatctgctgaggatgtcagtgtaacgcgttttctggtaaatcggatttctgctggtgagaagtaatatttcccggtatttttcctgtccgttttggttcggataatcgtatatttcgaaaaatagttccagggctttttgtactaattccggggaacggtatacaccgaatgaacaggataagacttctcttgtatctctgcttagaagaacacagagatagatgtttccatccatctctgtgtgatattgtcctatgccgacacacagcttgtgcggggacgggacctttacgcacggctgattgcacggctgatttggtattgggacgccctctgttgtatatggccgcttgtctagctgcggactctcggctgtttgaatcttcttggcgatccggagccatccggccccttgctgcagctctgaatcatccttccagaggagaatgtcttcaggtatgtcttcgtaatcttccaagtggagtacgggatttaactgctctaatctcatacttaatctcctaattctggtgattttatgttacggtgaaaacaggcgggatctgtttcgcagctaaattttttcattttccaggatatgtaatagcagaccttcgcatccttctactatatcgtcgtacgttctgtcgaaattgcctgtgtaccaggggtcggcaatatcacggggattgacggtaaagtctagaaggcggtgtaccttgtggtctgggtcggatcctatgatgcggtggatgttacggatattgcggtactccatgcctatgatgtagtcgtatgcggcgtaatccttcttttgcatttgaactgcatatttgccggctgtactgatgccttgggtctttaacttttggactgtaccgtaatggactgggttgccttcttcctcgcggcttgtggctgctgaggctatggaaaatgaattggctaatcctctcttttggaccatgtcgcggaaaacaaattctgccatgggggaacggcagatgttgccgtggcagataaatagtatttttttcatcttgattatattccttccagcttttgaataacacatttcaggttaataaaaaataggctatctttatctaatatacattcaaatacattcttaacattcagttcattatcaaagccaaagtattctgaaacaaacatttttatctcccatacaacaatatttattcttttagcattgctaaatagctgtccagtctttcattcacataccccgcaaataatttctccatcgctccccaattatgcttcacatggtattcgtcaaaagcactgtaatacgcaattcgatccgcaaattttatatcgatcggtggatatcctgctttcatcaattccagattcacaagcaagcgccccgtgcggccattaccatcgataaacgggtgaatgccttcaaattcaatatgaaaccaggcaagcctgggaatgatatgctctgggctttttctataaccctccagcaactgctccatcttcggctggattaaatacggctgtacaggctcatgttttgcccccataattcttaccggaacttttctgtatacacccttgtcatcttttttatcagccaacactaaataatgaatttgtttaatgatactttctgataatggtgactgttctttcactaattccctcacaaaatcaaaggcttccttatgtccaaccgcctccatatgatcttttaaaggcttctgatcaatggtcaaaccgcgcagtaccatatcagtttcacggagagtcagcgtattcccctcaatggcattggaattataagtgaattcaaccacaaattcctctgtcagccgctcaacctctccctcagtcaaaggacgtctggaatccagttctattttcttcctatcaatgttctcaagcaggctttccgcagacttataccggccatcctccggtttttgcgcctctgctggaaccttccaactgcgcccctcacgaataacacctggaattttcccctctgaacataatattcgtactcttctatctgaaatgccccatttctctgcggtctgttttactgacatatacatatttctgcacctcgcttcaaacaatagtatacccaattatcggaataatagcaacgctatcggaataatattacccctttttcggaacaatgcaaaagctcaaaagctactttttccaatgtaggtaagtaggtaatcatccggcagtttggcggatcatggaagaatatccaacatctcttcatttgccggaaacgcaccgaaatctttcatttttcccatcatatgtgagagatagttgtatggcttcagtccattcataagcgcagtttctgtgatactgaacacgggttgcatctccatgggcatacctgccctggaggaattcttcctttatcagtccataaaatggctgcagataccgttccgcacactgaatgatccaattcgccatggtctccgcagaaaggttcaggccataacgggcaaattcccgttcctgacgcgccaggggcatgccattgacatactttgcgttcatgatgcctgaaaccaggaatggtgttgccacactgcctttaagaagggaaggcctcttttccgtttcaaaggcggaaaggtcttccgcctatttgccgggacacttcttttataagaagacgaatggatttcctccatttccggctccggcgcatccggatctgtttcctgctctgcctcgttaaaaaggctcagctagttatatccatccgcgtatttttcgtatacggtaaaacatgagtactggctcattttttaccgccgtttccggcggccaggtctacacattggttgttttagatttgctccgacagatctccggtaactgatcgaaccatggaagcagttcttcaataaagctgtaatctgtatcatcctgatggacctcaatactgtcaggatgtggggcagataacggaacggattcaggttattcgccttagctgtttccgttatgctgtagatgatcgcactgtttagctttttaccgcaatgattccaaacatcatctctcagtcattgaatatcattgttttgatgaatttaaaaattgtcaaagtcactttgtccctttgcaatatttctaaagtatcaagttgatactttaggataaacctgtggtaatctaaagatactcttaatactcaatcctgaaataatccagataaactttatatttatcctgcgccgtcagacaggtatctgtcagataccccttctcattatcccactctttcaatcctcgataataaattagttttagatgatcctcgatgataaacggaacaatattatatttcagacactctttaaacataatcagtctgcccacacggccgtttccgtcctgaaatgggtggattctctcaaacttcacatagaaatctaaaatatcctcaaaggtcttttcttctttcgcattgtactctgccagcagggccttcattttgtcgacaacttcttccggaagtacggtttccatgccgcccacctcatttggcagtttcttatattctcccgctgcaaaccagtcttttctggaatcactggttccgctttttagtatcaggtgcagttccttaataagcttttccgtcaaagcgaattttgcatgatcaatgatcatatcaatacaacgaaaatgatttgctgtttcaatcacatcatccacattgagaacttcattttccacgccgatagtattagtttcaaaaatatatctggtctgatcgcgagtcagacggctgccttccatatggtttgaattatatgttaaatcaatttgagtcttatggtaaattccatctgaatatttacttgccttctgtccctgcaaaatatccagcaaagttatctgttcttttctcttgttggatcgctctggtttttcagcatcttccggaatgttccaggtcttgctggtaagaaatgcgccttttacacgcctatgagcgtaataatttctcacacttcgctccgatatattccattttttcgctgtttcattaactgagagatatcgcatatttcctccgtttatatctgtctaagttttccaaaccaaaatctccttgaatttttgttcaataactatctccacgcttaccgctttgttaattcttcggtcttgaaaacataataaccttcataatagtaactgtgatcaatgcccttcatataaattttacggtcataaatattatcagtcagggcatttatttcacgtccccttctatctttaaggcaccgatttcgcccgtttcactcgcgtaggtcaataacagctaatccgccaatctcttttatctcgaacttcatttctctctcaagccaaccaaggtcttgtccctggtgctcaacaaaaaactttaagtaattcggaattcctctactactatgcttaatgccatataccccgccattatatttagagtccattccaccaagttgtatcaatctctgattgaattcattcaataaatgaccgctcttgcttcgatcctgaaacaatttatctaaaagagataatttccatgaatgatttacgatctctgtatcaaatattttatgtcttggcaaattaaaaagaatctcactaatacttccagcatctaataaaaaacatccgttattacagtcttcacaccatcggagtgtttcttcctgtataaattgaatattttttatttgttctgttatgtccggttgtgttgtcgtgtaaaacatatataatggatacgaatttctatacctggcttcattcaaaagtaaatctatctggaagccatttttattaccataacttaataatgaataattatcctgattatttggccataactttttagcctgtaccaaaaatctatacccattatacttatctttataaaaaggatccgtcgttaatatccaccactcccaatctgctccattctctgattcttcatggcgtgaaaatgccttataataaatattcggattgctgcttgatatatcatataacagccaatccgtcaaagactcttcttttacatgtgcctgcttcagtaaccattcataaataaaagctgaacactgatgaaacacaagcgcttcttcctcttccccaataaatactactcttttcattagtgcctttcctccctggtggtatacggaatctcattctcttcacaccattcttccgcaattttacatagcgcctggaatcggtatgcgtagtattcttcatcaatacctaagtttataatttcatctttaaaatggcgataagcctttcttccatgcagtgccaacaaaagccgctcctgttttctttccgatgtcactcccagcgcaaacgtctccataatcttccactcatgtatttcatattggttcggaagacgttcataactatccgaagcatcaatctcttcctctaattcttcatcccggtctacccacatgccatccgacaacgccactatttcaccggtttcggtatttaaaaactgttcccagctatctgtacatgcctctaattcttcagcaatatcttctatacatatttgtttcttcattttctatatttatcctccgttagaataaggcactctgttataaaaaatattttgacagtttaattgactgattgtatatctctgtctgacagttaattcgagatatttattttatttttcgattactttttctgataataacattcagccacctttcagatttatgctctacccgcacatcctctgtaatccaccattcctctaatatatatccaccttgttccgagagtatttgtgacagttcttcctgtgtaagatcgcaaaaataccggtcaccagaccatctttcagaaagcccgtatttccatgaggcatataggacgcctccctctcttaaggcagtcatcattttcccgattatctccggtaacttatctctctttacatgcagcaaagaggcgcaggcccatataccatcaaacgcctcttgaaaatccatatcctcaaaacggaactgcactacctgctggccggtcagtcgttcagcagctttacacatcgactccgatgcatcggcaaccgtcacctggtatcccttttgcataaaccaatagctatcgcgtccactgccgcagcccgcatccaatatatgcgcacctggctccatgtattttaaaaagcggccgtaaacttctgacatatcagccttccaggtgttttctataaattcctctgcatgctcattataataggtgattgtcttactatcttccatccgtatttcccgccttccataaactttctggatttcttatttatttcaaggaagcagctacagaatcaaatccgcaggacatttccataatccatatccctgcagcaaggcggattcatgcagtggttttaaattatgttcaagtatattcgtaaatctttcctccgtgtttccctcgataaataaggtttcacttgcccatattgcattgagattatctctcctgcaattttcgaattttttacggataccgggattgctgaaaacaattttatataagtaatactgattgccagccagccccggaaaatagctgtcccattccggaagtctgttattcttgctggaattcagcctcttctccattggcgttaagttccataattcgtcatttgcgatatatgaccgtggaacaaagtgatccaagtcataacttttaagatccaattcttttcctgagtagatatcatatatcggggagccgcctatttcgaccgcacttttccatagttctctggcgtgatgcaatttccggatcttgttattctcgcgctctaatttatatatgatgccgggaactcccgggttacggtcctgcagaaaacggattttctttaattggatccagctgtatattacaggatagttatctagtatcagctgcctccagtggggattaatccggatctttttctgcagtccttttccatcaataatggtgtagagaagcgatgttttttcattcatccgattgatatactcaatcagcctcccccgctggttccaaagtttattcccgcccccgagttcatccaggaaagatgacaaaagcctgtacggaacgcagttcgtaaggttcgttttatcacttctcagttccttttcattcagcttgatggccgctataatgtcttccctttctgcatcttgtgataaatccgagttcttagccagagtgttaatggcatgttcaagaaaattctctgttttgttttttataaccggtcccagatgaaggtgaaaacaggtgactgtataccaggccccgcagatcatttcattaataatagcatcaaaacttaccacttcattatccctaattaaattcaggattgcttcgagccaatagaatttataacactgggaagggtcatccagcatttttgcaaatttaattgtatctagattattttcatagataatttctgaatccaattttaattccatactcatgtttccaccaatcccttacccgacaaatttaccgccgctcaatccgtcatcgatcttcttttgtatatgaaccaatccattattttcccagaagctcataatagaatatatactgctgcataaccccttcacagcccttataccgccttttcggaaaacccttcggataatgctgctttaaagcctgattaatatgagtgtctactggaaatgcctggaggtggtggagcgcaaacagacagatacagtcagccaccttttcgcccacgccgaatagcttcaacagctcttctttcgcctttttatacggcatctgcctgatctcatccagggatatatcaccatttaccacgcttttggatgtcctgaccacatatttgctcctgtatcccagattgcaggccttcagctcgtcctcatccaggcaggccaaagcctccggcttcggaaacgtatcataaatgtttccgtcagcatcctgttttctttccccgtacttttcgctgatattttgtatgcatcttctgatccggacaatattattctgctgggatatcagaaacgacacgatcatctcccacaagtcctgatgcaggatgcggatgccgctgccaaattctgaggcagacaacagatatcggtcacgctggctgatacatttttgatagtcttcatagtctgtatccaggtcaaaatagtgcttccaataattttcgtattctgcttcatcacaataaaatgtgcattggttcccgctctgccggatttccagatatctttccccggcgatcacggaatatgtatcttcccccttctggctcatccgaaaacactgtccggaattgcagatctgggatatatcaaaataattcagtgttttttcagtcattgctttcatccgtatctcttctactccactcctgactttgcgcagatatccgcaagacagcatttatcacagtgcggctttgtccgtgccgtacagacatcccgtccgtggtatacaagcctgtggcagaagtcactcccttctgccggcggtatcagtttccacaaggccatctctacttttttaggatcctttattccgtctaccagtccaatgcggtttaccaggcggatgcaatgtgtatctgtcacaatcgccggctcaccgaatacgtcccccatgattagattggcgctttttcttcctacccccggaagcttcagcagctcatcaaaggttttaggaatgccgccgccatattgttcctttaatattttcatgcaggcgctgatgtctctggccttgcttttgccaagcccacatggctttacgattcgctcaatatcttgcacatctgcttgggcaagcgcatctacatccgggtacttttcatataaatcttctaccaccacatttacccgggcatcagtacactgtgctgccagacgcacacccacaagcagtttccatgcctggtcataatccagggtacagtccgcatccggatattcctttttcagacgttctatgatttccaatgctaattcttcttttgtcatcttgatcctccaattaagactttattgaaatctgtttgcctgccctccgcctatagatatggaaggcttatccgctttcaagattaatcttcttctattataacaaccttgcacattgctttccagttataattcactacgtttctattatagatcaaagtgtacaaaccccaccccctcactcgtgtggggcttgtacactttggcgccgccgcgatgccgctttgcggctatataccttatcgcggcgtgtgcattccccggagggtttttatgtaatagaaaagtgcttagtactttcctattatataagaaacagagccgcagctccatagaagtttcttccactatgaaacaacagctcttaactttttttatgaaatgtcataagtactttatctcttccatcatagccggcctgttccgatacttatatctccaggattccacaatccgttccacggttttcggcccagtaatcatagcctctttctaatatcttggaagaaaacaaattttcccatccctcatatatcatatgtactgcctccatatcactttttttaattatatcactctgtgtgatggaaatcagcatgcttctgcaatatattcagttgaaactcagaatattggctgcatttcacccccaagttctcctgacgctttcctgctgtaccacgcaatcagaagtccaagtgcagctgccgcgtaaaagataataaacaccccatgatccagcttctcaaacagaaaaccatagaccatctgcccaaccggctgtgcacaggttgataccgcaatgatccaggatattactttcccgatcatttcctgcggcactgtcatttggatataggacataatctgtatactgtaaatagaagataaagccatgataaccattcctactgccgtcagcaatgtataagtcagatatgccggaccgtctatcattaaaataactccgaggggcaccagaagaattccgcagtatgccaacagtttccagcttttgtccaccctcagttttgcccccagcacgccggcccctactcctcctgccagtccgccgaccgccagagccgcctgcatgaatccatacaatctggatgcttcgctctctgaaaacctcagcagctgcataacgattacgggaagccctataatcatcagggaggacatcaccagatttaccccggcacagcaaagtgtcagctttccgatctcagacttctcacggctgatataagatatgctttgttttaaatccgcagctgcctcacgcagaacggagacattccgcgttctccgtgaagaagggatatgaataaagagttccatgaccgccgataaaaagaaacatcctgccgccatagccaaaaccgggtaaatcccccataaactgtatgcaattcctccaagtgccggccccagaaggcctgaaagcgaagataccatattaatgactgcatttgcctgcatcactctttcaccggacaccaacaccggtatgctggcctgcacggaaggctggtaagcgccggatatgccgtaaagcataaacagcatcaccataacaagccccgttatattaacttttccgtaaaatagtaaaaagaggattgtcagggccgaagtaaaaaagtccagaaataccatgatatttctcttatttacccgatccgctatgatacctccgattggtgacattactgccagaggaataaatgcgcacccggaaactacaccaagtaccgccgccgaacccgttacgttcagcagatgaataggcaatgcaaatctcataaccgcattgccgaacaacgaaataatctgaccggtcacgaccagccaaaaatcttttgagaatccttttttctgattcatatattctgcctccattttttattttagataccgaccgttggtatgtatatgtccaaaaattatctgtcctgtctggacaggacagattgtgaacatcctaactatttttgtttttctgatatatagctgcatattcttccaaagcagccagcactttatcgtcaataacattgatcccaaatgattgcagtattatgtgataaaattttactttctcaatcatctcctccggaccgcaatgataaatcatcgggttgagccatacatttcccagcagcataataacttccgccagctgctttggataatccgtctgaatggaaccgtcttcgattccctcctcgatcactttccagaccatttccgtcgcctctctctggacagagtcacgcaaatatagcacgagaagctgcgggttcttcagcatatccggagccacttcaaacatctccttctgtgcaggattgaaagcagataccctgaaaagttccttcagcttttccatcccgctcagatcttttctattggagactttcatcatctctgactcagagccaagatacatcttatctgctactgccatcatgatatcttcttttgacttaaaatgatggtatatagcccccttgcttagaccgcccaggtgatcgataatgtcctgaatggatgtatggtcataccccttctcactgtacagacgggcagcggtatcaatgattaaattcctggtttcttcaggatatttgtttcttgccatgtctcactcctatttctacgtaacatactaacggtatgtttattttacatacttacggtatgtatgtcaagagatttttatgttttactggataggatataaaagtaattccctatatcccgcattttattgcctagcttctttacttattcacttatttatattcattatatttaaagtttttacccctcacttcatcggcaggatacttttggccattcttctgtattttactggtcagtatatccttaagatccatgtgattcatctgagcaaaacgcagtacaaaaaacagtacatctgccaattcctcttcaacatgccggcgctttatttcatcgttcatgatttttttcatttcctcttcgtttttaaagcggaatatatctaaaagttcattcgcttctgttgaaatcccaattgccagatctttaggattatgaaactgatcccagtcacgctcactgcagaatgctcttactttctccgttaattctttcactgtataatcttccattttactgtaatcttcctttcaggtattctgccagatttttgtcaacacagtagacataacatcccttcatgccacgtgtcatcagtgtccgatatgtgtttttaattaattcatccgcaacttttactgcatgttccgggtcttctctgctcattttcttaattcccttaagtgattgatccgttaaagctcttttagtaaagtcagtaacgatatggccgttttcaaagcgcatatcattgccaatgataacccccgcatattcgaattcgagcccctggcatgtatgaatacagccagcctcattaacagagttttcgtcgattgcaaatgtggtggtgttctccagattccagctgatttcaaaatcatcaatttttatgtcatgcacctcagagttatttctgccctttttgggccagtcccaacaatatccggcaagtattctggcatggttggcacttctgtttttttcaatgattatttcatgtacttcctttggggaatccagaattttgatatcataattcaaatcctgcagatcgtaattagcagttgggcggatctccagcacgtcatccagccaggcaagatacccttcggacccattgcatctgaactgtgaggtcagctccatttcaaagtattctgcttcctctttttctgcccaccgttgaatctcagctttactcccgatatcactgattgttaccctttgactttcgtcaataaaaaacacactgcattttgcggcatgtataatctccatgatttggttaactccctgattatgaagcataccggacttttcatttaggcggtgggcctcatccacaagcagcgtgtccatgctgtctttcggcatcatagtataggcgcctgaccccttaaacatattatcaatactgcttctcttcatggttcccttcaatttctttagataaacatttctcggtgcactgtttttcgaaacatactgacaaaactgctcttcatatgtcaattgtgccagcagattaaccgctacaaccgtcttgcccgtacccggacctccctgtatgacaattacccgttttttttgatctctttgggactgtcttgctaatccaagaatctcttcatatactaccttctgatcatctatcatgacaaattcctgattccccttaagcatattaacaatggagtcctgcagactcttagacggttttattctgccactgtcaatatggtagattagggttttgttatcaccggcaacaatccgctttttgataaattccctaaattttttaacctgcccccgtgtaaatgcaggagcttcttttagatactccaaatactgcactgcatctaatggatcatctgattttcttctgtaattgtgaagatacgaacagggaaagagacgaattccttcgttctggacagattgattataatccccaatcagcattgcatatgaccatgcctgataggagggatgcaccacacggcgtactgcatttcctgtgtaggtttctaccagtccgtctcttccatccaccgcttcaagattgccccactgttttaattctataataatcacatttcctttgttctgtaaatcataaccagagatcaaaaagtccactcttctggatgtgtgaggaatgttatactcaattgcaattccggcattttgaggaattccttcatcattcagcactttatacatatattccagcgaattttcccaggcccgaaattcattggatgccgtatgcctgttcatcttctgatacatgcccgcttctatttccagcgctattgtatcttcttccacgcttttcaaaaaatccgtttttgtcccattgtaaattatcatcgtatctcatccttatattccccgattcactccactggactttgaaagtctgtctttaatatgttctcccaaagctttgtccatgcagtatactttacaccctcttgtccctcgtgtcagcaataccctgtatgtattttttacaatatccacttctcgtttcattgtcgcttctattccaaacttacgtaagaatttttctcttgcactcttgcttacggtatagtcatcagttgccctcttactaatatccgtaattattttcccattttcatatctcagatcttctccgataatgactcccacataacaaaattctaatccctgacaggtatgaatacagccaatctgatcaaatgtttcgcctatagcccagctgacaggatctatcttgtcatcattattccagcgcagattttcattttcaatattaaaatcatatagcttctttgttcggtcatttcgcgtcttccactcccagcaatatcctgcaataattctggtatttagatttcttcggttcatcttttccagagaaccttcaaattttttaaaattatcttctacctggatatcatacttgagactgactgcctctccttcctcattctccaaaagtgcgtcaacccattggatatagtctgtcattcccctgcacctgaattgtgcctgcagctctcctgcatcgataatatccgcatcctgacgctttgcacattccataattacttctttcgttccaatatcttcaaaggaaacaatctgtccctcatctataaagaaaacggaaactaccgcagcttttataatagacacaatctgtttttcctcgcttagtcgatgagcttcatcaacggtaatgacactggctttatttctttcgagtttttcgaagaaaggagggtatacgatactgctgctaaaccgttccattcctgctatttgtcttaagtcaaacctcaaaactgctctgagtgctttatttttcgcagtataataacagttcatatccgtatgctcacacaaacatgctgccaagattttcaaagctactactgatttacccgttcccggaccgccctgcaccaatactacttttttacgtttatcgcgtttggcagtattcagcattttcatgactgttccctgcattctttgctgttctgcatttaatcgcagggaactgtcatttacactcaatttttttaacaattctaaaagagtcagggaaataccacagcattttgtttcaatataagtcaatacgcttccattatcaccgcttttaattttctctgccagataagactctagtttctcatcctctcctttaaaaaacacggggatatttaacatataatttttatacccattttgaaaaagaggatcttcattttcctgtaagcagtaattatgtaatactacagccgggcataagtgcagggggacatcctctttactaatacctcctgctattgcatttttataataattaatctgataacatggatgatccctcaattcactcccgccgctcattgggatctgcactttatagcttactgcactgtcacagcattctatggctgaccactgtttcagttctattaatattgcagtcatttctccattatcatcaaatccggttattatcaggtctacccgctcggaaagcccgggtacctgatattcaacagcgatcccggcgtctgctgggagtcctgccttcttaataaccgcgtacatatacttctgcacagaatgctgccatgcacggtattcaccggtctgaactttccctgctaaaactctgtaatttttctccaatgttgccagaaaggttctattttctacatcatttatgaactctccaactgtttttgcatatattttcatagtttatctccacaggcagcccctgcctgtttgtattcttatatatcctgactgctctcactctagtgtaccggaaatacagatctttttcaacagacctggcaataaatcatgaaagctgcgttattttactgtattccctattccttccccaaataagcatccaaaatttcttcaaacaactccaccggattttcttccaaagcatttgccaatacaatgagcttctcaatgctaatccaatttttccccagctctacatttgccaggtgccgcggggagatccagggttctcccccaaacagttcctcgcttctgaggtctatgaagttttctctgttcttatactgttcaccaaggccttttctcttgcccgacaacagttcgcccactctgaccagcgcctgactgtattcttttttctccgccatgatttttccaaatatgcaccatggtgcatttattttttatagattttatattactctatttttataataaagacaaccgcatggaagcatttctggcattctaaggaggaattatttatgaagaaaccgctgaagtttaaagtcaactcccttcgaaccctcgtctctccctataaaaaaggagcgaaagatgaaagtacatatgagactatttattatttattggtggacatgaaggatctgcccgaaaacattcccctggatgtaaacccaagggagccaaagatgaccaccaatgttgccaaaagtctgttggccgcggtcacggaacccgagacggacttttatatcaacaaccgcggaatcgtaatcgctgccaaatcgcttacttttaacagcacagattccgaagttacgatcgatattggtgatcaagacaatgaaaatgaccggtttgtttacggaattctggacggcggccatacctatactgcaattattaaaaagcgcaatgcaatccctgcaggaatcacaaaatatgtccgcatcgaagttattacaaatgtacagaatatctcccggctatccgatgcccggaatacctctgtccaggtatcggacattgcactatttaatctggatgacaattttgaggaaataaaagacgcaatcagcagccaaccgtatgccagccgtattgcatacaaagataatgaaaataaacccattaatatctcggaattgctccgcctgatgtatgcctttgatatcaccaaatatcctgacgattctgcggccccggtgcagagctattccggaaaggctcaggtctttaagcgctataaggaagcctataacacccccttttataaatctctgaccagacagatccccaagctggtttctttatacgatgttatcgaacatgaactgcctgtcaaataccaggagtataaaaaggcattgggcgtcagcgtcccccggttcggcagcgtccgcgggattgaatcactggaaaaaagtgccaagacggaattcctgtgcacggataccaattacgttgtatccagcggatatatttaccctattttcggggcattccgcagtctgttgaaatatgacgtaatcgatcaggaggtctcctggctgttcgatcctatggaaatatggaacgaagttggggtaaatatcgtgcagaatacgttcgaaacctatacgaatccacagttagcaggtaaggacaaacaattatggctgtctaactatagaattgtagaaacgcagagcctgagaaaactgctaagcaatgcgcgctaaaatcacaaaagccgcagctcccgctggttatgaagggactgcggcttttgataaactgctgctttatgccagtgctctggcttccagctctttttctaaaaactgcctgatatatgcgttgttttcctcattcagtgtgggcataaatgccatatacctgcatttttggaagctttctccatccaggctgaaggaatatccggtcacacattttggattacagtcatccggatttaacagcctcttacatacagaggatttccggatatcctttttcatcttctcgggcagaatattaagaaaatcggcatactttccaagattctccggatagatacgcagttttactccggttttccggaaaacaaacgttgccagtgttttcttcgtatcgcagaaaacataggaaacaacaaacccgctctttgcggattttatatcacatttacaattgttctgtgtaagataatcattcaattcctttacaaagccctggtttttactgtcaacactggctagaaactcttcaaacttttcgtccataatatactctcctcttttatttttcttctatcggtatccatatctgcgccagataatcctgatcataggggttattgctgctgtaccactccagctccgggcagtctgcatgcgcaaagggatagctgatcagccattcctctgtcaggtacttccacccattttgaatcccctgcggcaccggccctctgcaatcgaagacagcccatgctgcctgtggaattatcatttcatggaatccctgcggagcctttctgtctgtgacggccatgatcgaataatccacttcatccggtgaatcccccggttcctcaaccaggccaaacaggccgcggggttctccctgatccatcgttgccaaagctgcgaaggtaccgtctctttgacactcactccaaaatccgggaattttaaccagatgggcatcattctcccgtgatatgcgggtacgccttccaaccagacggaatgcttccttttgttccagcctccaggaatattgctgttttacggaaatctgcatcttaggcagtatccgcagttcactctgatcacgcctggcctccatgggtgatataccatgaaactggtgaaacgcctttgtaaatgatgtgggagaatcatagccgtacttgtagctgatatcaactactttcatgtctgtactttttaaatcgtagcccgcaagagtcattttcctcgaacggacatactccgcaaaactgatgccattcatatatgaaaacaccttttgaaagaagccatatgagcaacccgctatttttgctatctcctgaacgtcaacaggctcctctttccgctgcagatgatgctccacatagtcgataatgatctgtaatttttcattccattccatatagctgctcctttaacatgcggtgatattattctaacattaatgtaatagggcttcatcttatttttagtactcactggatagtgtctgattttgtggacaaatatattctttttttaataatcttctatagctttttcctatatagaaagggacagagcctaaaaaacggccctgtcccttatcaatcatacttatactatctctttaatggcaaaccggtattatctgtgaaggatcctatggcaatcatgataatgtcaacaacccagccaaatccgaagcaccctgctgtcacaaaccacacgatgcctgtcccgtatttccccacataaaaccggtgtatgcccagataccctaccaggaagcatagaaccaacgcaagcatcttgctctttgggctgcaggcctctgcatattgctgattcggatatacgggcacaccatttgtaaacacttctgtaccatacccattattattagccccctgtggattggcatatccattattattcacatcctgtggattcacatatccattttccattctactgttctgtgtctcctgcggttctacatagccgcaataagaacaagttgccccttccagaggcgcgccgcagcgcggacattccccacccataatattttctcctcctaattttttccatattcaagtacgccagggcgtacttgctgcgaggtcgcgtcatgctttgcctggcataatacctctgtacgcctctgccatccgccggcggctttggatctaatcatttttccggtgcctgcagatgtaacactgtacaatacagacttcttccgatttccatgactgttcattcccataccgtttgcaaatttattttctcataatatgagtatagcaaattaatctcctatactcaatcaaaatctgtacagggcttctgtttcttcgtctccttatcggtctcccatgatcttcccgtagtatgaatctgcggtataaagcgccgccgccggattatgccccagtacgcggtctttcaccaccaaagtagtaacaggggctttcgaatacttataaaaaagactgtcatgacccacacataatccaattaaaatattaagatccgtttcttctttattcagtctcatggcctgatgaattggattgcacatagtagctccaacccccttacatttttcgggaattcccacttcagttttatcaaccgcccccgccttacacgcaaccccaaacacttcaaaaccatgacttcttaaaatccgtgctaatattctggactcattaatcaggcctgcacatgtggcaattcccagtttataataattcattctctttgcaaattctatcgtctcttctactctggtcattttacagtagaattcatactcaacttctgcggcattaagcataatctgcttattctcttctttatcatattcttttattgcaacatccagcagttcctggtcgctgttctctgttgtcagacagaatttaggatagactttattctgtgaaccacagttggcagttccacaatctatacagcttcttgtaatttcatctttcattttctgcatatcccccgcttttttatatttccttataagtacagggcgcgtaggtaacacattttccacagacctcgctgcccgctgcatttacttcgcctgcactgtttagataggaactgccgaactctgtgtgttcctgcgcattttccctgcacatggcatagcacttctttctgtcatatccttcatatgtaagtgcattcacaggacagtgcttcacacagaccccgcaggttttcttctgtttgtacaggcactgctccgttttcatgggttctcccggttccacattcaggtttgtcacaattgttgttagacgcccgcagcatccggcctttgtaattaacatattgttcagcccaaatgttcctataccgctggcatatgcaaaatgcctgtgtgaccagttgctttttagtatcttattatcaaacactaatgattccggcgcagtcattccgttgtacccatactcattcagtatctctattatcatcttattgagtctgggaaacattgcatttgtgagctcataagcctgagcccattccgcagatgcaagatgatccgtgtacttattacttcgcgctgtctttttggtaaatggaacaaaacagcataatacaacagatgcatcctgcataatatctttgggaagctgatgtgtacttctcacaatgtcaggcagcctccggatgtatggatgatttacatctgcgtaaccaataataggctgtctccagagtcttcctgctagggagtcacactgcctgtcgtacgcatctataaaatcagctattttagattccagtttttctttcatcgaattatcatacataagtaaatgctcctgctattaatatccggtaatactatagcataaggacaggttttacctgcccttatgcttctcttttcttttttgctgtttcagttcaaactgccgctgtttctctgcttcccgctgttcccggcccacagtcctgcgctcagttttcctctgctcctgctgtaattttaaagcttgctgcgatttggtgcctataccggtgttttgaacctgtttgtgcacctcccgctgtaccctcttgggattgcggccggattcttttacatcagcagccacggcctggctaaatctcaattgatcgtaatttttcagaataaaagcatacacttcataatctttgggttcagccccaaacgtaatcttacaaaccgatagctttccctctgatatccgttcaaaaacaccgatccagaaaggttccgcaaaaaatactgtcaattttaccgatactttgtccatgacaattcctccttcataccttgcggctgtcgcagtattcggcgaatgctcctgtaaacaaagcattatcctctttacctgcaaaaattgtgatgcacaaagaacggacgacccaaggagggagggttacttacaccaaaacggtgcggccggactacctaccggctctgcgggatgataaccgcgttgtgtttttatctctgtttcttgattttaccatatcctttctctattggtcaaactggaatcatcaattatatttatgaaatcaggcagctctattctgcacaaagcatctgctccaaaaaagcttcctgcgccgcaaatgccgcgcctgctctgctgttatctctttctttcaccatttctatctggagtccctttcttaaattatcatgcagcagccccgacactttcccctttgtcacatggaataattctggaaagtccgttacaattgcgccacccacgaggatatatctggtattgtacatatatacaagatttcgtatcagcatagccagatactgtccctgacgctcaacgaactcgctggcccagccttcctttcttcggtatgcctcgtatatctgatgcacgtccttcacctcatgtccttgttccctgcattgctcgattaagctattttttgtcaggtatgtctgcacacagcctgtactgccacagtcacatagccttccgctggattccaggataatatgtcccacttctcctgccgcattatcgcttccccgcacaatactgcctgcatacatgatagcagaacccacgcctgtgcctattgacagatatgtcacatcctcatgccggatatcctttctgcgatgcgccagcccaatcagagacgacttcatatcattgtctacataaaccggtttctggaatttttcccgggccatctgtcccagttccacatccttccattggaactgaggagcgaaaaatacagttccggttttgtaatcaatattccctatacaggagatacccactgcatctatgtcctccatccggcaggatgagtccgcgcacagcccaaggcagccctggtatgcaatttccaggatctccttcgcctgataccccgttccttcaagcctgatcctcttatgggctgtaaagtcatccacaaaattcaggatacatatgccaatgtagtccgaatctattgaaatccccaacgtaagcactgcatccgtctccacctctagcttgatcccattgcgccccacatttccatttgccacgctctctgactgccgcacgaacccggaggccataagtaactccgtaatcctggtaatgctggtggcgctcatctttgttatcttggcaatatctgctctggaaatgttagaattctgattatcacgtataatgttcaatactaacttacagttatttgcctttatatcgctttggctctggacacttcgcttttgcaaatttatccacctcttccttatttttcctgtatttgctcctattataccataagcaaaaaccgtacacaaacggattagatccgcatttcagcttaatatgtttccgtaaatggccacagtgtccagggaagcttcgtatatttgttccggattgctttcaaatcctgataagtagctccgggagtaagcgctatgatctgtttttttgcaaacttaacaatatcaggaaattgataagcctgctttacgacaactatatcgtaatcctcagccctaaaattaccgactctgcactgttccatatctgtaaaggaatccgccacttcacagattgtaacatccacatcccccaatgtaaccgtgacaagtccgcctgcgtatgtgttaaggcccgaacgcatggggtggtacaccagaacatgcccctttgattttactttcccctggatccgtaccggcaacgaccattcatctacccccgtacccagcataatatcaaattcttcaccgtctgccatatccttcagcttatggtacgcatctctgtcataaatcgtagagaccagcacttttttcccattgaaccgtcctttttccaaaaacaatttcaggaaataagtattcatgcccgtgccccctgctgtagtattgtccccggaatccgaaatcacaaccggatatgcctcgctctcacaggccatttcaattgctttttccggttccaccagctctccctcgaatctgaattcgtgtctcctgtcatagatttcctctgcaatctctcttgccgtcttcatggctttcccgtaatcttcctgattcctgggtacgataacaacggccgggtaagtgttctctgtgtttgccgaatgcatggagataaaaaatgacgcacacgccgattcccctgacgcctccatatttttaaatctggagattacagagcgcagaggctcgtcccttgtaagggcagtatctccgcacagcagcatgggcaggcgcacaagtgctggctcaatcttaaccccccgttttgaaaaatcaataagtgcctccgctgttacgcggtaagtatcctgctgatcctcatggggtgccgtgtggtaggcccgcaggatatttgcatatttcgtgatatccggagacagattcccatgcggatccatacctatggcgatggggatgtcataccctacaacgcttcggatcttcctaagcatgaacaattctccgcacccgatattctctgcatagatggcgccgtggagctgaagccagattccgcttatgttgtcctgggcgcgaatctgtccgacgatcttatccacataataccggtacgcgctttcctctatcactccagacgacatccagcctgcaaacgtgcagggcactacttccgcccccgcctctcggaatgcagacacagctcccggaaagtagtcaaggagttcctttccagttacttcaataaaatcttccttcttagtaaggataggattaaaagtattggactcatgataaaaacctgctattaaaaatttcatcttctttccctctttctttgtgcatgaaaatttgcagaggggtcagacccccctgggtttatgaggttaaattttcttatccttattttcaatatatttatctgccactacgataatcaaaagtatcgcgcctttaatcaggttctggatatttacataaatattaaacatgctcatgatgttaaatatcaaattcatcagcaggattcctgatagtgttttaaccataccgccttttccgcctgagatggcagtcccgccgattacaatcataggtagcacggagggcatggcatcctcgcccacagaaggagagcccgaacacatacggattgcaagaagtattcctcccatacctgccataaaggagcagaaagtaagggacaggcatttatatttttctacattcaggccataagccttcgccacatccggagcaccgcccactgcatacatatttcttccggtctgggttttctttaagaataattcaagtacagtcacacaaaaaagcaggaaaaggaagagtaccggtattggaccgattgaagccatacttagccttagcacaagatcagacatgatccccactggcttttcgcctgcaactgccagcgccacgccgcgtacagaaaccatcaccgccacagacaccataaaagcgggaagctttttgtatgccacaaagtatccatctatcagcccaaacagtgcagaacctgccaatgcaattagaattgctgcagccatcgggagtttttcaattgtaacggcaaaggtaacactggaaaatgccatcaccgcaccaatagaaatattaatctcaccggtgatcaaagtcatggcaaggccaagagcaaccacgccataagtaatcatggatgcaaggatgccttctatattattcatagataaaaaagctggtttcataattgggacgatcaggaaggccaaaacactgaccagccagatacgatattcgtttaacactttttttacgattgtcatgctccggcctcctttacagttttttcagtcggtttgtatacagcgccacgaggagaattacacctttcacgatcgtctgtattaccgtattaatattcattaagttcataatgttggtaatcagcccgagtatcaacacaccggtcagcgtttttacgatacttccccgcatgccgccttcccggtttccaccgataatggctgcagtggccgcgtcaacctcatagccatagccggttgacggagacgcgactcccgtcctggccgtcagcataatggctgcaatccccgcacacagacccgtcattgcaaaggaaaaaattttaatattgtgggcgttgataccggacataaacaccgctacccggttgctgccgctaagctttatttttctcccgagggtggtcttctgcgttataaattccaacacggtcataactgcaaacatgatgataacaagcaccggtattcccaaaaacattcctttgccgataaagcggtaagactccatgctgttatcgcagtagatattgaacccgccactatatgtatacgcacagctctgggccagaagcatggtgcccagggttgtcagaaaggaatcactactgtttcctttgataatcttgatcagtattccgttgaacacgccaaagagcagcccgatggccagcgctgccgcaatagccagaaatgtattcttcgtagaatttagggttccaaccgccaccactgcacagatagaaataattgtaccaatagacaaatcaaatccatctgcaagtataacgatggtaaagcctgctgcaagtacgccgttgatgcttacttgccttaacacatttgaaacattgttccaggtaccgaagttatcagaaaacacgattccaaatacaataagaaggaataagattacccaattcaggttctctacaatgagctgtcccgctgttttaagtgaaatttgttttgtcattacattctgttttccactcatattcttcaccctccttatatagcatattccatgacggtctgggcatttttatcattcccggtcaagtctgccgtgatcttccctttatttacaacaagcaccctgtcactcatctccagtacctccggcatttcggaggagatcataatgatactcttgccatccctcaccagctggttcataagaagatagatttcatacttggcacctacatcaatcccccgtgtaggctcatcaaagataaagaccttagcgtttgtgttcagccatttgccgatcacaattttctgttggttaccgccgctcaaattcatagcatactgttccttggtcggtgtttttatctgcattgcctctatcatttcgtcggcaatcttttcatcttttttaagatttaccatacccatggaaagggtgttatgcatattcgccatactaaggttccatctaacagaggatttcagcacaaggccttcctgcttcctatcctcgctcaagtatgcaatccctgcatgaagggcatctttggggctggtaattttaactttttttccctccacatacacgtcgcccgagtctatatagtcaattccacaaattgcccggccgatttctgtacgccctgcccccaccaggccggccaaccccagaatctcgccttccctcagagtaaaaaacacgtctgatagaactcccctgcgggagaggttttcaaccctcagcacttctttgccgcctgcttcaaagtctctttttgggaatttatttgtaatctcacgcccaatcattttcgagataatttcttctttcgtaaatgtttctatttttccgctgtcaatgatcctgccgtcccgcaggattgtcacccattcgcacaactcatttatctcttccagcttatgggaaatataaataacagaaaccccttgttttttaagccctctcacaacttcaaacattttttcacactcttttgtcgtcagtgtagcggacggctcgtccataagaattaattttgtgtttttataagaaagtgcttttgcaatctcaaccatttgtttctgtgcaacacttaatttttctaccagggttctggtgtccatctcgtagccgatccgctccatcagcgcatctgcttccctgtacaccttcttccagtcaatcagccgttttttccctttaaacagccggcccataaaaatattctctgctacagacagatgcggcaccaggttcaattcctggaagataatactgatgcctaagtttcttgcgtcgtccggacatttgatatccacattttgtccgtcaaatataatgctgccgccatcctttgcgtagttcccgttcaagatcttcattaatgtagatttcccggctccattctcacctataaaagcgtggatctctcccttatgtattctcagcgtaacatgatccaatgccttgacgcccgggaatattttcgatacattgttcacctctaaaatatattcttccatgcggtctcctcccatgctcttcccctaaggttgattctgcaatctgctgtaatgcaaaaatgaaacggacaagctttcctgactttctttcccatcgctgccacacagagagcaacagttcagacgagactgaactgttaccacagagacctttttttagaattctctgtctgagattcccctaagaatacttgaaatagggaacgggattacttatatcaaagaaacttgtccgctttatacatttttgaaatcaaccctgtccattctgctgtacttattccggtatgccgtgcgttattttagtagtctgcctgatccagagatgctgtctcctgtgtcatataggttggttctacgccgtatatctgatcaacattcctgccatcaagaaggtcatgcagcatatctactgcgggggctgagaatgcttttggcgggcagccgatacaagcgtacatttcaccgtccataaccatctgcacggtctgtgatgacgcatcaatcgttacaactttgatatccttacccgaattctgaaccgcttccagaacaccccatgccatttcttcacccatgcagtaaaaagcaccgatatccgggtttccggtgatcatatcttctgccgcattcatagccaccgcacggtcccagtcacagttaatttcatttacaacttcaatgccgttgtatttttctttgatctgtgtcctgaatccttccgacctctgggtggtattgtctgcgcccgcaaggccggcaattataccgactttgccttttccgtccagtgcctctgcaaccgcgtctgccgattttgctccagccgccttgtggtcataatccgcaaaaaatacattgtcataggattcgagtgcgtccttcatgtccgtcatcgtaaagacataaagccctttttccgccgcctgtgttaagatcggtgcgatcgctttgctgtcaacggtctgaatataaaacccattaacgccttggctgatgcagctctgtacaaggtcaatctgcttctgaatgtcattctccgggttcatggtgatgtgctcatatccgtactgcgcgcaggcatcttcccctgcttttgccagtgtcatggcccagtcattgttggtaaccataatggtggcaaatttcacatcgccttctgcaccgttctctgtactttttttgctttctgtggtgctgtcctctgatttcgcgggcgtgccgctgtctgcgcaggctgcaagctgtaatgccaatagtgctgcaaacccaagtgccgctagttttttgattcttattctcatacgcttcctccttactttttcctcattggttactttttctggcttcataatttttcgcaccgtattcctataaagccatagatatatttttcttttccccgctccagcgtaagcgggcaaaagtatatctcctttaccttaccctgtcgcacatatgtctatctgcatgacacatgcaaggccatttgtttattcagaagatagggtctgatatagccgcacagccccgacattggcaggacatcttcggataatgggattcctaaagtctctgtcatatatttccttcttttttgcatacgcccccacatatccggatactgcactgcaatttgctttcttaattcttcatctgccagcaggatcccatcctctgcatttgcacctgcatatcccggtacagaaacgatgatatccatttgaaacatcatcccgctctccagcctgatgtcagaatcctggtaaaacggagaagagagccattcttctcctgagacaaagtgccccggatttaaagaccatccaaaaattgcctttggtattgtccgttctactgcctcatagatatccccgccggtaatccctgttcgtatagtagaataccaggttgcgagggccgcatagtacggcttcacaacatgttccagatattctttctgtggttttggcagctcagtctcgtcgtgggcaataaatcctgttctgcatgaaaggcctcccctgagccctattgtcatggaaaatttatctcccagggccgtgcgcttatttctaggggctgttactgcgttggtaaatctttcccccgtggcgcagatcgtctgtacggccaggggctgccctcccggatttaaatatccggctaattcaagctcactctttcctacctggatctcttccatcaaccgcataatacaagctgccgcgttggaggcaccaaactcatagtgggctgcctcatttgcgttcacacgggtacgcacaccgtatccgggatggataaacaggtcacttttattgcaaatttcccctgtctggcctgtcatatcttttacaacattgacaagaaaataaggcgcgtcaaatattttttcgttattttcataccttgaagtaaacatcttccatccgaccactcctccccgcatgccttctttgattccagcctgcctgatcagctcctgcagcgtatactttgtctccatgggctggtttgggagcgaaaaatgaggtacatgtatcacatctgctttaattcttgcacagcctcccattttcagactctcatttcctagcagaagacaagccttcccgttttgatggatgactagcacagcctcctcaaatcggggctcaaaacccgtcagatatccaaaattccctccatgttcccgatctgcatatacaaagaggaagtccagattatcacacttcattttttccaggattttatgtctatgatcttccatggtcttatcggttaaatctaccgggaacgatgcggcctctgcctcgggtttctgtatgtaatcatattttatctgctgcctttgtattaacatatttgtttctccttcatttgcttctcatctgtgttccagcctgtcaaacaccatcttcgccgccccgtatattccggcgtcattccccaatttggcaagtaagaccggcgtcttttttttgactaacgttgcttctttttgataatgcctttgaatcatgtctgtcagaatacgcccaccctgggagactcctcctcctatgacaaacacctgggggtctatcacataactgacgtctgccagacattttccaaggaaactcatgcaatagtctaagatcatatatgcaagtgtatctccctccctggcagcatccacaatagactttgcgctcagcctttttgtgtctctcaaaacagaggctgcgtccgtaaactccagcatctgccttgccatacgctctatgcctttggctgaggcgatctgatccagacacccccgtttcccgcagttgcacaaatctgtctcatatggattgacaacaatatgcccgatctcaccggcaaggcctttggagccgttcgcgatccggttgtttaagactacccctcctcccacgcctgttcccaacgtaatgaacacgatactgtcataaccttttcccccgcctttccatagttctccaagcgctgctacattcgcatcgtttccgacatttacggatataccgttcagcatttctgttaggacagcctcaggatacatatcctgtaaattcaggtttacacagttctctactcttccatccgtaagaaccggccccggcattccgatgcctacgcctgccgtctgatatttttcacctttaagcgcttcctctatatgaaaaactgttttcgcgatctcttccataaagagccttccgccattcgtgcagtctgttggcgtggacagtttttttataagttttccgttttctgttaatacgccgtattttgtgttggttcctcccacgtcaatcccaattgctatcttcattctattctcctgttgaaccagccgggtgtgcctgtcaatccatttcctcttagactcaaagttcaaattatattgtcggtttttttgcctagtatttatttctcctatgatgttattattttagcactgaatctatatgatcgtcaattatctaaattttacaacaatatcgaactatttttagaacatttatacaacatttgttcccacatcccaaagtttagcatactccgaaaggccttttaacttaatcagcgaacttttctattaagtaaaaaggcccccgcccaacggcgaaggaccaactttcttccaacctcttataaccatagattgttctcaaatactctcttttccggatttcagattctccataaatttttctgcactgatttgacgctttagtccatccagcagctctttgtccgccctgggcaccatgaccgccagtgcagacagcgcctcctcattgttttttccttcccgcttaaactcacagaacttctcaacaatccggagcacttttacatttttctggtccggatcaacgaacatttcgctctgctcgtctctcagatatggtacaatccgccctgagagcttcagtggtgcaatcatgtcttcaagctcatctcttgttattccatgagacattacaaattccccaaatacatgaaacgcgattccaagttcaatttccactctttcattttctgaaaagtttaaaatatgcagcagacggtcgcaatatcttttcacttctttggcctggctgtatagttccgaatccatataccgtaccaggtttaaaatgaactgacaaacactctccgccttttccatgtctgcaagcctctttttcttccccagcagatatccgatctgctttcggagttccttgtaattcacgggcttgctcaggaacagatcggcgcccacattgaccgcctgcatcctgtcgcctacatcacttaataccgtaagtaatataactgcaatatgttctttctccgggtcggattttattcgtctgcatatctcaaaaccgttcatgccgggcagcataacatccagcaataccagatccggctgaaactcatccacaagcggcagcgctttcattccctgatatgctttttcgacacaaaacccccactcattcagtacatcatacagcatatcgcaaatcacttcattatcatctatcacaagaattttttccatctcatgcgcccccatatttatatttcctgctcttctgctgccggcagatagaagatggcctctgtccccacattcactttgctgtgcaattctatcttccctccctggacctccacccatttcttggaaagcggcagtccaaggccggttccgccatattctcttgaataagaattgtctgtctgttcaaattcgagaaatacccgttccaaatccttttcatcaattcctatcccccgatccaaaacacagaattttacatactttctgccgttatccggacaattgacgttctctgctgaaatagtgaccgtaccgttttcatgagaaaatttgatcgcattggacagcagattatagagaatctgcttcagcagtttcttatccgcccatacttccagatcatccggtgacaccgatgtaatcagttcgatagatttcttatatgtggtactttttactatcccaattgcttcttccaacacctcattgacaagacattctgcaggattcacattcagtttccctgcatttatcttagatagatccaggatatcattgatcaaaagtaataactggttactggagagccagatgttttttacatacttggtctgccgttcgttgagcgtaccgaaaagctcatccagcagcagttccgatgcattaatgcttccggtcagcggcgtcttcagttcatggcttatgtttgcaagaaaccgcgatttcacctgatttgactctttcagctcttcaatcgtctgctggagttctatggttcttgcgtcaaccttttgttccagagtagaattcatctccatcagctgctgggaaagactgtctgcttcctgatgctttttcacaagctcatctatgtactgctcaatatccattttgtttcgataaagagtttcagccatttcttccattgcaaccagcagttccttcgtttcacggctttgattattcatattcccatagccgtgcgccactgtaaaatctccctggcagatattccgtgcaatgtcggcacttgcccggattggtttcgtgatactctttccgaatagaatactggataccaggataataaaaaatgtaatacagattaccgtaattacaatcttccggttcacagaaagcatctctacaaatatagtttctggaatccccacgctgagatatccctgaaagtcatcaaaatatcccttcagaggtttataaagaaagtaataattatctccgatcggcgcatattcagaaccaaaatagatctcattccccgtctttgtcccctgtgtaatatccggtattgttgtccctgtataatcacttttatcttccgaaaaaatgttggaacatatccttagatcgtcaagagatatggtaagataagaatccggtataatctcagtgtactctgtggtatagtaactgttcttattgatgatatcccccagcatcagatatcccagtacctgcccatccgtatccttgacagggaaaattacgatcgccacaaggccgtcataactgagctctcctgtggattccagcgtaaccgcatagttttctgccaggccgcttcccttctcaaatatatcgcgcaggtctgccacgcactgtgttttgatcacacggcccggggcctgttctatataggggagcgatatcttccccgcacgatccgcgttttctaccatatgtgccaatacatttcccgatgcatccacgaacatgcccagatcaagatactcgtattcttgttttaagtctgataaacttgcggcaagctgctcctgattccccgcctggtaaaactctctgacatcatctaaacggataattagagaggcccctttttccatctcattcaaacgggcatcccgaatctccattgccgcgtacacagatgtattcagataattctttacagaattatccagcatcttattcagtgcacgattggagaccagcaggacaagcagcatggacaggatcatgattacagaattaaaaattatgagccttttattaatagacatgcgtcacctcttgatttcctcagcgtccagttcctgacaaatcaacatcacatcaattcggttctttacattcatctttcttataatgttacttacatgtgtctttacagtcttttcacttataaaaagactttcggcaatctcaagattactctttcttttcatcaaaaaatcgatgatgcttatttcccgatctgttaggccgtatcttttcatcagctgagtgtataggtgactgttgtgagctgcgaaaccacccgccgcttccggcatatggatcatagcaagaatactggagagaaactttagaatattctccaggtcagatttcttcatataattaacagaaaacttttcgtaaatttcatttttttcttctgaaagcgaaaccatgccgccgatgaaaaaagcaataatgtcgttgtcataaaatatcggatacaaaaagtaagccaggcccgtgtaacagtactctataatcggttccctctttttgagcattgctgcaatagactcttttctgtaggaaatgcattctgtggaattgtttttttgaagcttataacataacaaagactcatttgaccagacagtcaacggttctccgtctatcgaaagaagacacaggctgatattgtaacttgccgcaaaattatcctgaaaggtctgtacttgttcttttccaatagactgaagccaccttaatgcaattttatccatatgacacctttctatgtttcgatacggttataaagttatacaacaaatatagcagaaatccagattgttatcaataatagcaatctggatttccgctcctttcttttaatttcatgaaattttacttctgtatggcagataaattatatacaatatccgtatcgagataacaggcaattcctttatcgaaatacacatcctgaaggtattccaagtccttttttgacaatgcttcctggtgcttatacttatatgccgtgccaagctgctcccatttggatgttcccagtctgtggaacggcagaagattgatttcaaaaaatccgttctcattcataaaatctgctgttttttgggcattttccacactgtcattaaatccaggaataatcggtgtacgtaggattattcttccgttccagccactttttttgagtgcccgaaggtttcttaatgtaacctcgtttcccacgcctgtttttgccttatgtgcctgcgagtccatgttcttgatatctacaaaagcaaaatcaatatactctaatacctttaggaatatgttttcatccgtataagcggatgtctcaattgccgtatgcatgttatttttcttacattccttcaatgcctctaaaagaaattcccactgcacgaaaggatccccgccgctaaaggtgacaccgccatcggttccccaaaaatctttatcccgctttaacacatccatcagttcctgcagtgtgtaatacgtgcctgacacccggagcgcttcataattacacgcattcgtgcactgatactctttacagtcgacacagtgcgcccgctggatcttcggtaatccgctttccggatccatggtaaccgcgccgcgcgggcacgcagccacgcagcttttacaatgattctgcactgccttgcatctgccggaagtaaataacagattctgtttcagctttttcccctcgggatttgcacaccactcacagcgaagcggacagccgcttaagaatataagagttctgtctccgggaccgtcatgtacagaaaatccctgtatgtcaaatattaaacccttcttatccataacaatccctcctgaacactagtacatcatataataattaactgccacttaagcagacctaaatttccgatagcactgctccacaagcctcagcgtcagcccactacgcctgcgtttgtggagcagcactctcgaaactttatctcagcttatgagtcagttacttattttacgatgtactggtaacttatttttttaacttatccggcaattttgcagctttgggaagtgtgaatgcaaagattgcagataaaagaaacataatagtagccacgatgaaagacaccttataggatccgaatacatcatataatttggctcccaggtaacttccgactgcaggtccgatacccataatgatcagagtggcaagtccccagatttttgggaaacttcttccgaatatagatcccatatatcctgtaacctgccccggcattccctgccagtatgctgcaaaaaagatacatgcaacaattgtaataaagatggatgtcttgcctgccaacaggcagatcataccgaggactccgcttgcagccgcaaagaacatcagaattcttcttgcttttgtctcgtcacctactctgcctgcatacttatcggagaaggttccgagaagcggtgcgaatacacacccgagaagtccgacaaacgcataaaggttcgtactcgttcccatagaaaggccgacgtctgtctgccagtagcgaaccagctgtgaccagatcagaaattcagagaagcaggaacagaagaaggacagaattgacccccatacaaaatatgttgaaaatgcttcttttactgaccatgcgtatccagccgtttctgatgcggatttcttgccgccgatcatctcaccttttggttccatgccatatgactgcggcgcctgttttgtaatcagcgtggctatcaataacagtaccagcgcaacagcaccgagaagcttcatcgccacacgccagtccattgtcaggagaaccgctttcagcccaagtgtcagtattacctgtgcgatacatgcacctgcagccgcaaacccaaacgctttcccataggcatttccgataaaccagcttctgatcgtagatactgccggaacaaaaagcatacccgttgcggtacctgcaaaaatagaatatggaagcagatacatcatataggaatttgcatagcttgtaacgaaataccccagaaatcccgcaaccgtcgcaataccaaagcagaacttcggcccgaatttactgaagataagcccggaaaaataagatacaaccgcatagatcagcatcatgatagaataccctgccgttacacttgctgtatcccatcccatatccgtagtcattggggtaagtaaaacagagaaagcactgcgatatccaaaaaatacaaaataaacaagaaaagctgccgcaattaccattaaaccatagtttttagagtttgacttctcattcatatataagcccccttttcatgatgcaggcgctaaagcgcctgcatggccagataacctcaattatctattttgtctcatatccttcacatgtcttagcatccatatcttcgtatgcccagtattcagacttcagccctttgcacatgccgatcccctcttcattcaccccacaaaaatggctgcagttcctgcattttgctttttctgcaaaagccggacagatatcggtatcgatcaacacaaaaccaccattttttctacaaaagcctttaaatacatcaaactgaacaaagtttttacaatcgctatgtttactcatatcagatacctccttcaaattctgtccgggcaattacttcgtcctgaaccggtttgcctgtctctacccagtactgtgtaaatccagaaactctgactaacaaatcccggtttgcctccggatgtttctgtgcctcttttaacattttagaatcaacaatgttaaactgaacatggaatccgcccttattcataaatgctgaaatcatggtcagtaacttcttgctcccgtcaagtccgcgtactgcgtttggatggaatttcatattaatctgcgagttctgggatttgctctgatcccaacagcacccggaagccagtaaagcatatggccccttccggtctgtaccaggatatgcagacatggaaccatctgcaaatgccgtattgcacaggcgtccatccggtgttgcaaatgttgccatacccactgcagcatgcagcgccacggagatctgacatgcatacattggttttgcatacagagattcgtatgtattacagagatcgcagaaccagtcttcatactctttcagaatctctttcacgtagtcctcatcattcccatgttttggggctttcaggcagtcgccatgaatctcatcatattttgtaacatctggctttttaatctgctcgcccaatgagaatgcttttgattctactgctgtatagaagccaaagttatccttgatcgcatctctgaaatcatccaatgtgtactttttctcttcataaacaagcttcttcaacgccgcaagtgagttaaccatattgatcgtaccgcaggactcgatattataggtcgcattatacctggttcccatatgtccgatatgatgtccgttcttcaggcagtccggtttgaacagggagtttacaatagacatatttctgtcacgccagatgtcatgctggatattccccgcttttacagtcggctccaatgtctttgcataatactttttatactgatcccagaaatcctcataggtcttaagctctctgttgtgcggcggaagtacctgtatgccggttcttggatccacaccgttgaacagtaccatattgatcatcttcggattcgatacaaagtgtacgcctaccgaagttgtctggcttgcgcctgccggaatatagtgtgtctttccgttgaaatgaagaggcatgaaacagccaggcgcagtctccagacatccgccgattgccactgcgcgtgcctcagataccgtcatcccctctgcgccgtactgattcatcataaagtccatcgcaacccggttattcatccatgccgggtatccaaccccagtcttggtacattccacacacttaatcaggaaatccttcggaagtctctcatcatataataccgataaagtcggctgtggagactgatttgtcatacccgcatgaagaataagccactccagtctgtttccacagggtgcgccgtctttatcaaggcctcccacagaaaggttgttaaatgtattgcctgaaatacctcccgagattcctgtgcttgcgaacagctcaattgtactgaatttgaaacgatgtacttccagaagctcaatgacttcttcttctgtaatagttccatctgcaatatctttttcaaaatacggataaagcacctgcccgagacgtcccggagagtatccggagattgcatcttcattcaatactgtaatatggatcaaataagtaagatgcagtgcttctctgaagtttctcggtggattgtgggcgatccattccatctgttctgcaagtgcaagatactcttctttctgagctgcatccggctcaatctcagcaacggttctcaattctttcacataattcatccagaactgctgaataccgcctaatacaatacgtgccgcctcgtagaaatacaggcgtttcataccaaggattccgtcgccatctgcaaatcctgcaacttccagtttcttttcctcgcagaatctgatcattccgtcaattccatattccagtgggaaatagtagcttgcaacttcacgtccctgcggaattgtatagccgctgtcacagaacaccagaacgctcttcatgatatttgccttgtcttcgtagtcagacatcatcttctcatacgcaagaccaaggtcttctaccgattttccggcccactctctcgccagtttcgtaagtaccggtacttcttccgccctgatcccgaatttacctgcaagagaaacaacttttccctgattcttggttacgtttccgcctccggttccaagcgctgcaatctcatcaattgccgtcgttccacttgctgccgcactcttcaattcatcttcttttgcaaggtagaatgaattggtaagccatggcattggaaaaccgcctcttaaataatctgtttttccgcccggaagtaaatctttgggataaatactcggggtagaatgagcatatgcgcatgcaagcgcttttgcacggcggacttccagcacatctccgtcacattctgcaaactttctgctgtaccagtaagggaactcaacacttgcgcttgaaaatgcctggtaatacagatccattaagtattctgcacgttttgttttttccagcttaatctctctgtcaacaatctcttcggattgctgtaagtcatcactgccgtacgctaaacccattgacattcctttttctgccagaatctcttccagccgttttcctctctcaatagcgtccatacaattctcctccttttgaaaataatcgttgtcttcagccttataggggctgcttgatatattattatcatagtataagaggccgtggattcctattgaccagggggctcttttggggtgtatttttaggagggctcagacttttttagttcttttctcgggcggggggcttaaaaaggatgtagaggtggggaaggatgtgaggggtggtaagtatttgacaataataagagcccagaaatccgcataaatgctgaatttccagactcttttatattcaaactcggtgtgccctttattgttattaaatatatttgtttaagttttgtacaaatacacaccatttattacttcaattacatcacttattctgccttactgattttctgctgccaatatgttgccatattttaaacgtcttttttcacatcatactacctttttcatcttggataaacagcatcgtttcgagaaaggagatacacacaatactgattcatactgataccttctcttttggaatgctctgctaatgagcggtgcagactgcgaggtattctcaacttaaactgtccagaataatctcctaacttatccggctcatgaatcggaatcccatcttcaagtgcagcttcaatccatactttttttgcatccagtgcatttgctaccgcagattctactgtctcaccacaggtaatacacccaggaaggtcaggataggaaaccacaaatccaccttcatccttatcctctacaatctccatccgataggacattgccatataatcattcagcgtcttcatcgtttttcgcctcactttctacaatttgctttaccaattctacatatacttttttaatcggttcatgctttggtatcgtaagcggctgacatcccgatttccgaaatgtataatgactgcttccactcctcggagcgttcatttcatatccataactttctaacactttacgtaattcattgaaccggaggtctttagataaagaacaaatacgtgttaatagtttatcccactttgacatcttgaatacctcctgcttatattatatgtggtgtcgtatttggtgtcaacatttttatgcgtcaattttctgatatattctggcaacaaaaaattctgtaaataaaactaataaaataatacctaatatggcaagtaatccacagactacctgccatataaaataaactatattaaattgaaattactcgaactctatcgtccccggtggtttccccgttaaatcatagaacacccgattcacatgccccacttcattcacaatcctgctggtcacccggtgcagcacctcccaaggcacttccgacgactccgcagtcatgaaatctatagtattcaccgcccgcagcgccactgcatagtcataggttctctcatcccccataacccccacagacctcatattggtcagagccgcaaaatactgccccacaatcttattcattccggcagcatccatttcctcacggtaaatagcgtctgcatcctgcacgatcttcaccttttcagcggtaatctcgccaataatccgtattcccagacccggcccagggaatggctgcctgaacaccagtctctccggtatcccaagctccagtcccgccttacgcacctcgtccttaaacaagtctctcaacggctctatgatctctttaaaatccacataatccggcagtccgcctacattgtgatgggatttgatcaccgcggattcccctcccaggccgctctctactacatccggatatatcgtcccctgcacgagaaaatctaccgccccgatcttctgagcctcttcctcaaatacacggataaattcttctcctataatcttccgtttctcttccggctcgacagctcctgcaagcttgctgtagaatctctcctgcgcattaaccctgataaagttcaggtcataatgcccttccggtccaaagacagcctctacttcgtccccttcatctttccttaaaaggccatgatctacaaatacacaggtgagctgtgatccgatcgccttggaaagcaacactgctgccacagaagaatccacgccgcccgaaagcgcgcagagcactttgcctccgccaactttttcccggattgccttgatcgtctcttctacaaatgcatccatcttccagtctccagcacagccgcagacattctttacaaagttattaatcatctttgtgccttccgccgtatgcagcacctctggatggaattgtatcgcatagaggccgtcctgggctctttccgctgctgctgtagggcagtctgcggtatgcgctgtgacttcaaatccgggcgccgcctgggagatgtagtcaaagtggctcatccagcagattgtgggggtggaaacatcttcaaataccttggagtccggcttgtcgatgagcacttctgtctttccatactcccgtacatccgcacgttctacccggcctcccagcacatgcatcatcagctgcgcgccatagcacaagccgagaaccggtatgccaagcttaaaaagttcttttgtataagtcggggaatctgcctcgtagcagctgttcggccctcctgtcagaatgattcctttcggattcattgcctttattttttctatatctgtcttataagaatagatctcgcaatacacgctgcactctctgacgcgccttgcgaccagctgattatactgccctccgaaatccaggacaatgactaattcatttttcaaatttatcctcctgttgaacacacaatgtctaaacctattttaaatttactttcctattataagggagggttttgcgatttacaagactctcttttaaaaaaacgcgcatccacgtctggttttcaggccgcatttccagggaaatccatcgccctacactgtataatctgttattttccctgcttatatactccgcatcaatttccattttccgccataatacctgaccatcatgaagacggcccggaagcaccagtcgattaccatggccacccagactccaaagacgccgagtcccatatatcttcccagtatataactgaagacaattctgaagatccacatagaggcaatggatattatcatggtaactttcgcatccccggcagcccgcagagttgcaggcaatgagaaggcaaccggccacacgatcatacagctgatgctgtggaaatataatatctgcttcgttgtctccgccgtaaggtctgataagtggtatgccttcaatataaatggcagcagaaggaaaatgactgcgttcataatccagatcagtacgtacacaatacccactagtttttttgtgtaataatgtgcctgttcgtaatcccctgcccccacgcacattgcgatcacggaggtgatcgcaagattcagtgcaatccccggcagaatttggaacagagccaccgcattgctgaccgcatttgcagcgatcgcataggtaccaaatgtagataccaggctcagcaccataattttccccagctggaacatgctgttttccaggccgttgggcactccgatcgacaggattcttcgtatcatccgccagtccggacggtaatggaagctcctgctgatgtgcagctgccgcttctggtcagtcagcagcacggtaattataacggccgccacgaccctggagatcagtgttggaattgctactccttccgttccccgatggaatccatatatcagaagcgcatttcctccaatattaatcaaattcataatgatcgaaacctgcatggacaccttagagttgcccatggcacggaatattgccgctccggcattgtataatgccatgaacggaatggaagctgatacaatcagcaggtatgtattcgcatgtgccattacatccgcgtcgatcgcaccgaataccacatgcaggataaaccattttccacagtaaataatagccataatccccacggctacgatcgtgataaaccatacaatctgattggaagcttcacaggcgttttcgtcactcttctgccccagatactgccccgatataaccgcgcctccggcggccagagctccaaaggcattaataaagagcaccatgatattgtcaaccagtgacaccccggataccgccgcctctccgacactcgctatcataatcgaatccgccataccgaccagtattgcaagcagctgctcgataatcagcggaattatcaatgctctcagtgccttgttatcaaataaataggcgcttctgtctctttgttttttcatactctcattcctactctttcattcccatatcaaagtgggcaggcacacctcaaatcaccacgccctcactcaagagggactcgcacactttggcccgcataaataacaaagtgggcaagaccactcaactccccaccatctcactcaagaagagcatgcatactttggcgccgtcgcgatgctgctttgcggttatataccttattgcggcgtgtacatctcccagagggttttctataataggaaagtgccaggcacttttccttcatagaaaaaacttctcagcgcgtacattatacgccgagaagttttgagatgcaagttatacgctttgtttgattaatatcgcccagatatcgcagttaaattacagcccgcactgccgcttttatgccgcagcgtactttgagatttcctgtttcaggtcttcgcagtcctcatcatagattttcagttcaatgggatgattgaatcccagattcataatcccaagtatcgacttggcgtctactacgaatctgcctctcttcatatccatatcataagggtacttagcaaccttatttacaaaatcaagcacttcttcagggttttgaaattttatgatcatttgattcattgttttctctccttttttcagactatctatgacggctttcattagcttctgcttttttgttatcgacatcatagcacaattttttccatttacaaggacgaaatttctgaaaaaggtagaaaaatttaatagactgacttacgaaactcatttggaagcatgcccacttcctctttaaaaaccttgctcatatacttgggatccgagtatccggccagctctgcgatctgatttagcttcaggtgcgtatcggctaagagctgtttcaccttctcaatccgcagcttccggattgtttctgaaaatgtgacgccggtttcttttttgaactgtgcgctcagatattcttccgaaacaaacagtttatttgccacttcctccagggtgatgccctggtcatagtactttcggatcatctgctgggccttctgcacaagaacactcaccggcagctcctctttttcctgcatattaagatccagcagttcaaagaacttttccatgctgcgtttaatctggtcccagctcgccgccccggacacttctcccaggatcccttgaatctcgagttccgcatccagttcctggatgttcccccgcgaatttgctacagcccagttgaaacgtatgagagatttcttgatttcttccggcagatggggagactccggataatattggaacagcttcctgtaacattctttgagcgcctcccgatcccccctcttgatcgcctggcatgcctcgtcctccagctcagctggatgcttcaagggcacgatttttaacttttcaatctcctctttcctaagcaggattcccttattcaaaagaaggttccattccttttccttctgtattccgctgacagcctccggtaaatccagaatccgctccatgctcttccagatgcagaccactgggcttttcagattgctgcacagcatagggactacagaattctggaagtattcatataaggcacagtcccgtggaacccggtagagtatcataatcagcatctgccacgcatcggcttctatcacacaggaggcaaatttaacagtgtgggcgcccacatcctccagcagatcctttgccgtttttttctgttcttcatacccgtctcccagccacagagcgaagacctcggcgggatcttccacggagaatccgtatttttccatagtcatattatgaaactgcttgtccggagccagctgtccgtttaagcatccaatgaagatgccctggacggtaaatactttatcctggcttttctctttgtccaactcctcctcgatctgtcccagagcccgtttcagctccgggatcttgattggcttcaggagataattctcaatatcaagctctattgcctgttttgcataattaaagtctgagtaagctgacaggatgagcactctgcagtggttctgctccttccgcagcattctgagcatcgacagcccatccatcttcggcatctgtatgtccagtatcaccagatcgggttccattctccggatcagctcatatccggcctttccatccccggccttccccaccaattcataatccgggtttattttatgtaaaatttttgcaaggccttcccgaatcggcgcctcgtcttccacaattacaattctcactgctgatcctcctttccgggcacaaacaaatgcacctttgtccaacttcccagcatactttcaaaataaatggtggcatcatccccgtagtacagtttcaggcgtttccggacatttacaatacctacgtgtccctccatgtcctgctcttcatcattcaatctcttcaacgtctccggcccaatgccgaatccgttatcttctataaccatgtggatctgctcttctgtccggcgtatcacaatcgtcaggcggcagtccccgtccttccccccaaacccatgtttgatggcattttccacaaagggctgcagcaaaagcttatggatcttatatcccatcatatcctcaggcacttcttccaatatcgtcagcggctttccgagttttgctccctgcagcatacagtaatgccgaagccatcccagttcctggcgcacggtagtcgtgcctcccgcatttttgacggtatagcgcagaatatccgccagcgctccaaccatcccgctgatgtcatactgctcattttctatggccttccagttgatcgtgtccagcgtattatacagaaaatgagggtctatctgtgcttccaatgcggagagttccgcgtttttctgctccacaacagccgccttcacctggccgatcaggtcgtcaatatggacaaccatctcattaaaccctgttccaatccgccgtatttccggcggcatactttcaggaatctggatgctgactccaaaatctccttcttccagatcattcatagcatttacgagagaatccactgccgccagatacggctgcgtggacatgtaaatcaaacataccataattgcacaggataccacagcaatcacgaagaaaaacaacacctgttcccagattgccctgttataatcagccagcggctgctcattgcagattgtaaaaccgcttttctcatgcagcatcgccgtatacttacgatcagctgtatccttctgactgttaaattggcttccgatagctgcagagtccggagaactgatcaccgtattaccctgcagcagatatgtggcattgtccgtacccgacaccaaagtatcccgtatctgttcctcgttgatgctgattaccacgatccccaggggatcattgatattcctgtaatcgatcagttttctcccgatctgaaataaatacgttttccgttcatttgcagtcaccggatctgtgagcccctgatacacatatcccttcccaatctccggaaccgtgattttatccgcccagacactgtttgtggaggaagaattcaaccggtcatagaatataatacgcccgttccgaagcgatatcgtgattccttccactcccgggttactattgcagatatggctcagttcatgacgcagtgtactgctgttaacgtccagatcatcctgttccttaataatttcaagcacggtatctataatcgtatcatccgtacacatatcatacaggattgtctcatacttttccaataccatgtccagggatttgttggcattgtacaggttgctgctgatacggccgtctatgttgtcctgcaggctgctcctgagtctcatctgggaaataacagcaaacagacagaccggcaccagcgctgccagcagaaatctaagagacatcctggttctcaaggttctttcccgtttcataagtctcccctcctgatctcagccatcctttcagctgcctccctcagaatctcgtcctccgttttttctccaatgactgtctcccccattgcatccgtaagtactctggatatgtacggccattccacggagaactctctcgtcctggcagatttggcaatctctatcatactcctattcaacgggtcttccacatactggttttcaagcacatcccggcggggagccatataagcggaacggtccatataggaagacattctttccttatcgctgacatactgcagaaatttgaccgccgcatcctgatgcgctcccttcgtaaccccaaaaatctccccgcccagcacggttgtccgggtaccatcatcggccgcgggcagaaccgttaccccgtacttcagaaaagggtttaaatcccggatagaggcaatcatagacgaagaggtaatcatcatagcaatattgccctcaataaactgccgcagaagatcgccttctgtcaggctgattgtctgcctgctcatggcccccgattccgttagctgccgaagaagatggaatgcctgcctgcttccggccgaatccagtgaatctacctctccgcccatcgaccacaaaaggggcaggaaactatatacactttcttcactctccactgccggaaggccgaaaccataatgaccgtgatcagagagcttcactgcagtatcataaagctcctgccatgtctgcggtacttttgccccatgcacttccatgatgttcttattataatataggaccgcacagttcattccataaggcagccccatcatccgtccctctacactgcaggcttcctttatttccggcagatattcctcaaaatccttgatctcatctgtcagatccacaaaaggttccattgcatgaaaataatgaaaatccgatgaatccaccaaagccagctccggcatattaccatccgccatgcttagggccagttttttcttaaaatcttcatccggcacatactgggtcgttacttcaatctcatcctgggtgcggttaaatccatttaccaaattcgccagttctttttttacatagctctggctccagtagtaccagatcgtgatcttctccttttctttcaccgtgtcctgctctttttctgcacatcctgcggcagtccccgctgtcagcaaaaaagcaagcagaagtgcacagattctcttatatctcttcaccgtcgtttctcctttgtcactataactgaacctgttgtcatttacattaggcattattccattcttccagtacatcataaaataagtcgtcgttcattcatttatgatgtgccagcttgctgtcccgccgggagggcaccccttccgccggttatttgacctgctctatgcagcactgaaccgatgatggtataatgtctaaccacattataccataatcaaagaattcatgaaaaccctggcatcaggcggggcactttgccgatatctatgacgtgccttcgactccactgctgttacacgcaaagtctatatctgtacacaataaaatgcacctaagtaccgggttgtctgattcccggcgcctaaggtgcattctatctgtatttctccgtttcgctgtagttactagcatatcgtaaaataagtaactgactcataagctgagataaattttcgagagtgccgctccacaaacgcaggcgtagtgggctacgctgaggcttggagagcagtgctatcggaaatttaggccggcttatgcggcaattaattatgatacgatgtctagtgctgatgcagatatttttctctggtagcaagtccgccgcgtatatggcgctcagacttattcatgtccagcaccttccgtgcctctcccgccaatgcaggattaatctgtaggagccgctccgtcacatccttatgtaccgtactcttgctgattccaaactgcttcgccgtctgccgaactgtggcactgttatctatgatataattggcgatttccacggctctttcctcaatataatctttcaaaaaaatccccctgcaatcattgtttttacaatgtatgcgcgggggaaggagagtatgacttgctaattgccgcatgattgtattcttttcatacaagcgtaaatttctctctattattaggacttcacctcaaagcccagttctttcagcatctgcatatcctgctctatggttatccctgctgtcgtcagcatatctcctgtaatagccgcattggcgcctgactgaaagcactgtttacctttatccgccatcaatccgcggccgcccgccaggcggataaatgcatccggcacaagaaaccggaaaactgccgttatcctgcacatatcctcaatcgttagccggggattcctctcatatggcgtgcctggaatcgggttcagcatattaaccggaatagaacgcacccccagatctctgaccgttaaagccaggtcaatccggtcttccatcgtctccccaagccccacaatccccccgctgcagacgctaagcccggctcgcttagcagccttaactgtctcaatcttttcttcataagagtgtgtcgtacagacctccgtaaaataatttctggaggattccaaattattatgtacccggcaagcacctgcctctttaattttccgaaaagccatctcatccagtaacccaaaagatacgcagaccgagatatccacattctcccgaattgcccggatacttttacacacagcctccacttcaccgtcatccagccttttccctgacgtcacaatcgaatatctcataactccccgctctgcattgtacttggcctgttccagcagctgctccgtctttagaagcgggtagctctcaacctctgtggaataaaataccgactgtgcacaatacttacaatcctccgaacactttccatttttcccattaataatggtgcagagatcaaagcgttttccacaaaacaccgcccggatctcatccgcagcctcacataaaggttccagcggcagctctgccaattgcatagcatcttccttcaaaagaagatcgccggcaagcactctattcttcatgttatccagtaaattttccatcaatttgtctccctttgttactgtttttactactatattataaaatcccgcctcaattgtcaactcatctttgataacagtttacattcatcataagttctattaaatcaggatttagttggcaagctttagacttgtcgacgtacggggacgcttcatgacagggaggccgggaaggcactggggctggctcatccaatcggcaggaaagcccaccaaccgggtgggatcccggaccagggcagcggatgttgattggctatgcgtatcctttcatcttcaagatgtgtattgaattattttgatactggaaccgtatcccattgcttttatacacctactagggacataaaagtaccaccaattctatatccatacgctgcccccgtttgaggccccaccttaggaacgagtccttttcctgccggttggatgcgccagctccataaagggatagccgaacacctcccggagaacatccatgtcctttcaaaaacgctcaaagcggaccttagaaattcttggtgggaaacagcccggaaaatggagagatttttggattccgaatccaaaaatcagctgacccagcgcgagaaatcatcggatttctcgtgatgtgtcagtggtgctccattttccgggctgtttcccgcctagaatttcttaggttcgcggccgcgtttttgaaaggacatggatgttctccgggaggtgttcggctatccctttatggagcgcccccatccgcgccgaggctaaagctcgtcgctaaatcccgattcacgcaaaaagctcctgatacagtcttttcgcatagttatccgtcataccgctgatatagtcggttatcattaatattcttaaataaagtttttcctcctcgcttttccccgccgactcatgcctgtacattgatttatagaattctgacaccgtatcaattatcctgcggtcaataaaattgattttttcttttgtatcatatccgaccgccgccggcataaactggctgagcagggaatcgatcacacgccgtccgaataattccctccgggtttttacggaactggtataaatcttctcctcgctcagatccgagatcgcgcaaataatatgcccggaaacagtatctttaaacaaatctcctgaaaaatgtccctgcataatcagctcatattctcttacaaaggtttcccccgcatctcttatcataatcccctgcatgaactgattccatctctgcactgccgtcagtcccggttttcttgtattctttgcggcttcctcccgatacatttccgatagtttttccacacactggcagaccccctgcttgttttcatgattgtcttccagattttttccgcattgctcaaatgtttccatgatctgctcgaaactgatcactttctttaccattgcatcttccaggtcagacgtccggtatgctatatcatccgcggcttccagcagatatgacagcgggtggcgggaaccattcattcccgttttattgtttatctcctcaaataacttccgttcagaataatagtaccctattttcttataatggttcggattactgttcctcaatttttccgatgaaatgggatatttaatgatggcacccagaacactgtatgaaagattaaagccattttccctgccaaggtaaggagtctttgataataagcgcagggactgcgcgttgccctcaaaagtatacagatccagaagctgccaattcgacaggatctctgtaagtttccgttctccgagagccaaatctttcagatgtgtctggaaccattccctgatcgcatattccccaaaatgcccaaaggggggattgccgatatcatggatcagtccggcgcacaagagcacctccgaaaattccttctcagagtgattcccaaaccatggatcttttctgctttctcttgttttcttaaaagcatactcacccagttttttgcctatggcagaaacctccagagagtgtgtcagacgtgttcttacatagtcgtcctcgtcaagaggaaatacttgtgctttatcctgcagcctgcgcagaaaagtactgcagataattgtctcataatcgtttctgtccgctatgctgctctcatgctgcatttcaacaaaatgatcttttgaaagtaatgtctcccattccatctgtgtcctctccttttaaaatgccttagagcgtgtctgaaaattgcttgctgcaagatgttttcccggtttgcgggggatttactgccaaatgcaagaggcgtcgtgggctacattaactggatttggcagtaaatagaccgtgaagcggggcggcatattgcagcaatgaattttcagacacgctccagcagcgctacttaatgaatttgtctatagcctgattcagttttcggattgcctcctggtcattttcctccacagcttccacgatgcaatggtcaatatgattcttcaggacaacttttcccgtattattgatagcggaacgcaccgcggccagctggatcagcacctcgctgcagtcctcatccctctcgaccattcgcttgaccgcctccatatgtccaatcgctttggaaagacgatttataaccgcctttttctccgcctcgctgtggacatggcggtgcgccgttccatgcgcatgagcctcttcgcttccgtgagtatgtgtatggagatgaacgtgaagtttcccgttgtcatgcatgtgttcctgcttatgcaggccgcttgtcacgtccaattcctgttcctgcatttctgttttcttttccatggctgttattctctcttttttctgttttgggcactctcagaaactctcttgcatccatctttaaggctgagttttcgagagtactcgtttttacatttattcatctttatattaaaatatcccgtccagtacttatatcttaacaaattttgccggacattgctattagaaatcattactatgcacggccccggaaatagtaatcagatttcattctgccatggtttcgcttactgatccatctgtacctgtctggtgcatacccggcccagcagttcccggttatggctcactgcaatcaggccgatccctctcctttctacttcccggacaagaaaattccagatctggctctgggtaatcagatccagcatggtactgatctcatccgcaagaaggaagcgggtcctcttccccagcgcccttgccaggcagaaacgctggagctcccctccagagagctccgatggaaaacggttcagccagtccggctcgattcccagttcctgcaggatccgctcctccacctcgtctccctccagaatcacgtcccgcatgcgcatccttggatttaccgcaagctccggctgctgccagatcatctgtaccggacagtatcccctataagtatgcaagggcttcccgtccagcaggatttctccggtgtccggcttcagataccccgagagcagcatacacagcgtggtcttaccatacccgctgggtgcagcgagtccaaccctttccgtatgctccacagacagattaaagttctccagaatcatccgatcttcttttttatattgataagaaacatttcttaattctagtctcataacggctccatctccccagacctgttctcccctggctatattttttccgaatcagcattatggtgttaagaaccccccccccggttgtttatacggcagataaacacctcacccggccgcctctcagttccctatagggaatctcctggctgcactcctgcgtacaccttgcgcatcggggtgcaaacgcacagcccttcggcatatcttttgcatagggctgtacgccgtctatacaatagaatccattgcgcggcatggcccgccagagtgcttttgtataagggtgccgcagggtctcctcgtgatggaaatcagacaccccggcctcctctatagactctcccgcataaaagacgacaatacggtctgcggtttccagcgccagttccagatcgtgtgtaatgaccaggaccccggcccccatatccgctaattcccgaaaatggcccatggcccgtttggccactctgagatcaagcccgggggtaggttcatcggcaattacaagcttcggctcttccatcagggcagttgaaatcaggatcctacggctcatcccccccgacagttcaaagggatacagcccctccacgctttcttccagatcatatcttgtaaagatatctttcagcttatttcttgtccttttatcctttttgcccttgcgtatctgcggcccgatcttcatcaggggatcgaggcatgacaggctttggggaaccatcacaatttcactgcccctgagctgtttgatgcgttccgcagtcagttcactgccgcagtatgtgatcctgccgcccgccttggcattgtaaggaagcaatcccagaaccgcatgtgcgagcaggcttttgcccgagccgcttgaacccacaaccgccaccatctcacccgcaaaaacgtttagatccatatcccggattacactcattgtctttcggtacagtccctgttcataccgggtaaaggagatattcaggtgttctatttttaagacaggagccgcttctgtactctccgtttttatgtctttatctaatcccatcattatttcatcccttccgcaaaactattcgtgcatacttcctggttccgtaagcttcctcagattttctcccgccttgtagaataaaactacaaccagtgccagcataatgccggggaacagtgcaagccaccactttccggtgatcagatatttcatggactccgaaaggataatgccgatagccggctgctccgaagacaggccgaaccctaaaaatgtaaggcttgattcatgcaggaccgcatgcggaaagatcagaaccaggcccacaagaaactgtggcagcaggtggggaataagatgtttcctgacaatataccatctgcttttccccatcttctctgcaacttgtatataagggctttcccgaagctgaatcacttccgcacggatcagcctcgccagggagggccagtgtgtcagcgcgatccctgccgccacccctccaaaccccttccccattgcaacggatatcagtatcagaagcagaatatggggaattcccatgatcaggtcgatgaaaaaggtaatcaccgtatccactgcctttcccagcatcgccgatgcggctcccagaatcagcgcaatgaccgcgctggccgccgccgccagaattccaagcagaatgctgatggaaagcccgcgcagggtgcgcaccagcatatcccgtcccatccagtccgtaccaaaaaggcagtttagcgaaggagccaggttctttttggaaaaatccgtggcacgtgctgcatctgcgcatagtgcgcccacaatgcagacaacagtcagaaccacggcagatatagtcaggcttatgagtactttttgtctccggttcatttccccctgcctcctctcctgattctcggatccacgacgccatagaggatatccgccagcatattaccgccgaatacaatgagagcggtggtcaccgcgaccgccatcagaagtggcagatcgcttcccagcccggcagtcactgcagcctgtcccagccccggataggaaaagacctgttccaccagtacagagcctccgaatatttcactgatggaggcaaaatgaagagtgactgcaggcagaaggacattgcggaagccatgctggcaaaacagccggaatccccgctgtcctctcgcccttgcaaacatcatataatcactgttcatgatctcaatcattttttctctggtatgcagcgcaatattcgctactcccgtaatactcagcgccgccgccggcagaattgcatgatagatacggtcccagacggtaaccccggcagcctccacaccgataggcacactcaggccaatgggcaggaccttcagccataccccgaataccaggagcagcacaagcgccagccagaacgtgggcgtgcctgctatcaaaaggcagtatcctttcaccgctttgtccgcccatccgccctgattcatcccggcaactgctcccagcgcaaatcccagtattccggaaagaatccaggcggtaatcatcagcacaagggagttcatcagcttaaccttcagcacctccgacaccggctgacggtatagcagggaagttcccatatcccccctgataaagtccgacgcccaggataaaaactgccgcaccggagagccatttacgccccagtattctctcagtttctccacctgatcctggctcatgctgcccagtgctgcctgccctacattagcctgcagcggatccaccggtgaagctttcatgagcaaaaacgtaaggagactggccgcggtgaccagaagtagcatatatatcaactttttccctatgcgaatactccactgccgtaccatatgaaacttcctccacttctgtctctctaacgggaaaacgggacgctttcttgtaaggcagcgtccctgatctctatttctctttattcccacgaccactgatcgacattgttaatgatggaccagccatgcccgtggggatgtattttctgttctgcaatctgaagcccgtccctaacaaaataaagatgatccacattgcacagccagatccacggaatgtcaccgtcctgcgtaatcccctgcgtaccatcccactgtgccttctgccacagctcataggactcctccagagtgcctgtctccagtgcttcatccatgtacttgtcaaccgtctcatttgcgtaaggcgaatactctgcctggcctatgccggtatccgaaagtgtatggtaaatgttatagagctccatcggtgtatgtgcgccccagccccagatcagcggttcggactgtgcgcggtcataggctgtatcccagcctacaccctcggtggtcacgtcaatgcccagctcctttaactggttcgcagaatcctccgccaaagcctggcgtacagaatctccactgctgaacatcagagtaaacgccgctttcacgccgtctttctcccggatgccatccttcccttctttccagcctgcatcgtccagaagttttcttgcctcgtcaggatcgtattccacttcgcaggcgctgttgtaccatggcagtttatcgcatacgctaaacgctgttgtaccatgcccgttcagaacattatcgatcatctcagcccggtcaattccgatattgaccgcccttcttacattaacatcggctgtgaatgcattaccatatggaatgccgtccttttcttccggttcggatgcaggcagattaaatccacggttatccacggtctgcaccgcaaacagttcgtatccgtccacagactgttcactgtaggatgccgccgtatgcgccacgtcagcctcacctgccatcgctgccgcaagtgccgcatcctcctccatgaacagcacggttaccttcttcatctttggcgcctccccgtagtaatccggatttgcctcaaagatcacctgctgtcccttgtcccactgcttcataatgtagcgccctgatccgatggggttctgtccgtaattttcatcgtaggcgtgttccggcacaatgcccacaatggccatggtataaggccagatggaaaagggcttcgtcatccggaattccacagtcgtgtcatccagcgcagatgccctgtccagcatcgtaaaatcattgaccgtacttttttctttgcagttattatacgtaaaagcaacatcagacgccgtcagcggctcaccgtcggtaaacttcacatcatcccggatcgtaaccgtccaggtcagcccgtcttcgcttacctggtaatcagcagccaaatccttttctatcttcagatcctttgtcgtcaccgtaagtgtactctgaatgagaggctcatgaacatgctcccccgcgccccagccataggccggatcgaacccggcttcgggttctgacgtggccggcatagtgactacaacagagtcccgctctgcctctgcggcgttctctgccttgctttctcttccttgtccgcagcccgctgacagacctgccatgagtactgctgtgcatacgatactgatcactcttttcctcatattcccctcccattttaagccgatttttgtccagtatagcatcctcttttttccgtcacaacccccttggggggatacttttccaaaagaaaaaacacagacggaaatttctttctgccgcctgtgttctccataattatgccacaacaatctgatattcctttcgaaatgtctcctggccttccaatcggttaatccctggtttttcggaaatgtctcctgcaaatccatgatcatcacagcgcccggcccaaggctccaggcatacaaaaggcgcatccttaacggaccagatgccaaaattagggaagcccttacagcagagccctgcataaggggtcccatccttatggcagatccacacttcctctatctgcccattatcgaatatcagcgcatcattggcaaacagttcctctgtcagagggtacgtttcattttccaattccattttaaaaacctcatccggattacccgcgccggattccggatgaaccagaatatactccagcacttcttttcttggaaatctgagacagtaatcttcttttttctcgtactttccggcaaaacgaaatgccggatggcccccaatcgtaaaatacatcggttcatcggaaggatttttaactttccactgtacatgcagcgtctttctttccagcctgtatgtgatgtacaattcaaagtcaaatggataaacctcctttgtctcctcgctggagtgcagaaggaagctggccgtatcctctgtggatttgatacaggtaaatgtgttatctctggcaaatccatgctgagacgtaggatactgaagcccgtctatacggaccgtattctggtaggtcttccccacattcggaaacagtaccggggaatggcgcttccagtacaacggatccccttcccacagcacctctgtatccttttgtttgtcaaagattctggttgcttctgcacctgcttcttcgatgtccacgcatagaaattcattttccagtctcatattcactgctcctccatttctggtctgccggccggtataggtccctttttcttctattattgatcagttcagaaatataaccggttactattctaccataatttttatgatttcctcgttggtctcccgcatgccctcttttcccaagcgtcctacatttgctatggtcttttccacaccctttgtgatgattccatccccgccgtagaactgctgtccctgcatgtacatatgataccccaggattcccgcatctaccgacgctgctatcttagccgcgcaggatgcctttgccccgtcgcagaccattccggacacgattgccagcgcatttaccaccgtatgtgtaatctctttatatccgcccccgcagagatacgcaattcctgcccccgcagccgcacctgcactgactgccccgcagtatgcggacagcctgccgatcccggtcttctgatggatcgcgaccaaattggacaatgcaagagcacggtacatcttttctctgtccacgttcagttcctttgcgtactccagaaccggaagggaacaggtcagcccctggtttccgctgccggaattgataatcaccggaagctcacagccgttcatgcgggcgtctgatcctgcagccgccatggcctttgcccggttcctgacatcatttccataggactccagaatcacgcttccgatattcgcgccataattgccacgcaggccttcctcggcgatctcggtattataatcaatctggcgcttcaatatgtcacgaatatcctcaatatccactgtctgtacaaaatcccatatatcctccacagacaacaccccgcggtccgtcaggccctcttcgttctccccccgcaccggaatatccagcagaatttccccgtctttatcaatatgtacaatattggtgtggtaattggcaatccgcacctgcgcgtaggattcccctgcagaaacagttatgataatgtcaaatgtaatgccgttatctatgtgctctacccggatctctttctcatccagaaattcctgtatttcttcaatctcttccctggacacttctgcaattacttccagctctttttccggtcttccggcaatgataccggcagcagcagcagcagggattccttttaaatggtctgtattgggcactatgacgctttttacattcttaatgatactgccgcttgccccgatatggacacgctcgggtatacaccccagcacttctctggccttggccgccgcatatgcaagagctaacggctcggtacatcccactgccggaaccagctcttccctcaaaatctgtatatacgcctgatatttttgatctgttttgttcatctgtacacgatctccttccaaaatctaccggcacttcctgtccggtccgcatattacaaatgtacactattccggaggaaagtgcaagaaccatgagttaccagacaacctaatttatcgtaacaattcaggcgggctggaactgctgcggtctattctccgtttttgtggctgcctcctgcctatgcccatatttcctctggcagaaattatctgtataacaaagtgtgcatcccccgaagggtttttatgatataggaaattccagaggaatttcctatatcataaaaaatccccggcggtctataagacaccggggactcttcctttcatctgcttatgcaattttcctgtctttgacataattctggagacgatccagcagttcctggcattcatcactgtgaatgacaagctctacgccgtcagccttactgattgcaataactcctaacaatgattttgcgtctactatattctttccgcttttaagatccacgtcgtattcaaactggttgataatatccacaaactcagtaatatcttctggctgacgaaaacaaattcccaatttatgcatgtcttgttttcctcctttactttgtgtatatggttattttatccagaatactggattttattcccaatgtccaggactttatttgtaaatttatatgtcgttatttgcagaaatttgtcgaacacctaaaaacagaccttagctcatgggctttagattcgtgagctgatagagaatgcttaatgaaaggacagccgcgagcctccgcaggaacatacctgtcctgaaaaaccgctaaaacggatctttgtaattctaggcgggaaacagccgtgaaaatggagagattttttgatcccgaatcaaaaaatcagctgacacagcacgagaaatcatcagatttcttgagctgtgtcagctgtgctccattttcacggctggttcccgcctataattacttagttccgtgtccgcgatttttcaggacaggtatgttcttacggaggctcgcggctgtccttttattgagcgtcctcatccgtcgaggccacacccccagttcacttacttctcttcttcactgctctcagactgttctacctgtacgcatttatctgccagatactctgccactttctgctgcagtatcgttctcttgagtacatcttctccaacctgctctttgaactcatccgcattctcatagcctgagccctttgcgtattccgcgatctgctcttcatattctttgctggacggctccagttttttctccttagcaatcagttcgcatgccaaacttctctgtactgctgtctgggcagcttcttttgcctgtttattgaaatcatcttctgaaagccccatgtactgctcagcaaaatctttgaactccataccgtaggcttctgccatactgctgtaatactcattgatggactgtatctgatcttcaacctggtcatccggatatttctttacctcgatctgaccgagcagagcttccatcacttcgttctgcagtgtactctccgcactttgtttactgctttcttccagctgctttttgatttcctttttatattcttctacggtcttggactcttcgctgttctcttttacccaatcgtccgtcagctccggaacggtaactacagagattccgttcagtgtgatattaaatacagctactttatcggccatttcagtatttttataatcagaagggaactttacctcaatatcaaacttctctcctattttatgtcctacgatctgctcttcgaaacccttgtaatctccgtttgccccgatgaagctgttggagcccagttccaggctggcgccggtggccgaaccgccctcgaactctactccatccacagatcccttatagtcaatattgaccgtatctccttctttggctgccctgtccttgatctcctctgatgtggattttgaagaaagcgtggaattaatcgtagactcaacgctctcatctgttacctcgctttgttccactttgggaacttccagaccctcgtactgcttaaccgtgatatattcgttagaaagttccttgctgcatcctgccagtgatgccgccatcagaacgcttaatgtcaatgccaatatcttttttttcattctttcacctcatattttcttatctccgggcagactcctgccaacatactttgttactatacacggcctatgaccgtacatagtaacggcatctggctcatttaaagtcgcctatggcgaagagccagatgcccgccctatcactttattggctcggatgccgtgcagcaaagtgcacggccctgtgaatcgtaatcatactttaacgttatatcatattttttcttcgttgaaaaggtttttcatagttatttcacttttgtctttacaaaagcggcgaaagcaaccgcgaaaactgctctttgatccggatcagcaggctacgctggtcataaactttgcgggtgacatgggtacatttcgtcatgtcattttcaaatgcacgctccaggcgctgcacggtccgctcgctgtagacaactgcatttacctcaaaattcaggccgaaactgcggatatccatgttggctgtgcccacacaggccaccatgccatccacactcagggtctttgcatggagaaatccattgttgtacacatagcactttgcccccgcttccaccatgtctccgagataggaataggttgcccagtacacaaacgggtgatccggtttgcacggcaccatgattctaacatcgatcccggaacggctggcgatcttaagtgcatcgagtatggagtcgtccggtataaaatacggggtctgcaggtatacatggtcttttgcgctgtggatcaggcgcagataattatcgtggatcgtctttatctgggagtcagggccgctggaaataatctggaccggatcatgtccatttcgcacgtaatccggtatctcgaagagatgatcctccaggaaaagattttccctggcagcataattccagtccagcacaaaacggactgccaaagatgttacggcagccccctctatacagagatgcgtatcgcgccaatatccaaacttcttgctgtccaggccaaggtactcccggcccacgttgaatccgcccacaaagcccacgcggccgtcgattaccacaatctttctgtggttccggtaattcacacgaagctgaagctgtcccagcagagccgggaagaattccgccacctgcacgcctgctttttcaaggcgttcccagtccttgttatgcatggtccggcatcccatactgtcaaacagcacccggacttctattccttcccttgccttctgggtcaggactggttcaatttcctgccacagctcatcgttacggataatgtagtactgcatatggatgtatcgcttcgcctgtttcatttcttcaatcaatgcccggaacttttctctgccgtccgtatagattcggacatcgttgttgtcagtcagcacggactcccctgcctccagattgtaaagaatcaggtccttgaagcgcgccatctccggattggcaagcctgagctgttttctataaatcgtttcctcctgccttcgaacggcatatttcagttcgccttcaatctctttcgccttaaacatcctgcttttatgaaaatcctgtccgataaccagatagaggaaaaaaccaagaatcgggataaaatagagcagcagcagccaggtccagactgtctgcggagatctgcgctgaaagaaaattatgatcagggataggagaatattgatgataaccagattatccattacaaagttataagccgttatcaacccattccatatcgtttctgccatataatattaactcctttattcatcggtatgtaacatatttgattatactattatatttccaaaaaagtaaccctaaaatgtgacagatcataaataaacaagaaaaaacttactgttcataccctgcggacgtgcacagtaactgctgagcctgcttggcacgtgcccctctttgaaaagtttctttataaatttaattttctgagcaggctgtatatatcaagggttccatatcccccatttttattggggtaagtgtatccttggttgcttctgtctgcaccgcgtatgatcagccgattgacatcgtatcccgtaatggtcgaataatatccctttacaaccgcccattcgagcagcattgcaatcgttcctgcggcatgggcttccccaagttcacagggataaggattcggattcaaaacatttataatcgaatacctgtcattgatttttatggcctgaccgttttctgattctgcatttctcaccagcatattatcgataatcaggtctagatagttttcatctataattttattcaatattctgcctcactgtatttttaatatattatattaaaacttccttattatagaatatcaaattgcttgcacttccctccaaagaatggtacaatactacttgcataatcgcggaaaaagagtatttataggagggttcatcgtgagtttaggattgaaaataatgctcattgtcttggtagtactgatcatcgcattaattttactgtatattttcggcaaaagatcagaaaaaaagcaggcagcacaaagagagcagatggaagcagccgcacagcaggtaacgatgctgattatcgataaaggaaagatgaagctgaaagacgccggtttcccttccgttgtcgtggacaatacccctaagtatctgagacgtacgaaagtaccggtagtaaaggcaaaagtcggaccaaaggtaatgacgctgatgtgcgatgcacaggtatttcctctcattcctattaaaaaggaagttaaagcaaccgtaagcggcatctacataactgccgtaagaggagtccgcggatcactggaaacaccgcagaaaaagaaagggctcttcgctagatttaaaaaggacaaaaagtaaattccttatgataaaaaataaccgcagtaatctgatcataatcagaaactgcggttattttcttacaatggagcgcaaaggggtcagacccctatgaaaaggggtctgacccctttgagtaaatgtccatctttattttacaatcagccaatggttcatggttcacatccagttcgtaatccaccctgactccaatgttgtcgtccgtaacatttacttccatgttctttgtattcactccgatcagcatctgcccataaggtgtctgataatacgtgagattctttttattcttttcaaaaatcatatgggcattggatataccggttttcatgatctccaggctgtctgaaccggttatttttattttattttttattgttccgggcatgccttccattacttcatcataaagtacgtaatggttcccgttcctgcagtaataactgccgggtgttacgacctcgatggcctcgttttcttcatccgtcatgccggcgataaagtccgtgtgcagtccggatatgctgaccaatacatcctttgtcatatggttcacctaatattcttcaatgttaactacgtttgtggttgatatgtcaaacggcatgaccgtgtttgcaaaatgccggaatttttccgcagcatcgctgacaaaaaattcataacggctgtggggctcctgctgcccgccattctccatatcctgctctttcagcagctttttcagatccatggctgtctcataggccggattcacaatctggattccctctcccatgtaggcacgaatcttagaccgaagcaacgggtagtgggtacatccaagtatcatggcatcgatgtctgtcttcttcatcgattccagataaaaatcaataatctcccgtgtgacatgatgttctttaaacccttcctccacgagagggacaaacaatgggcatgccttttctatcaccgttatctctggattcatgccatggataatcttcgtatacataccgctctgcaccgtggcatctgttccgacaacaccgacctttaagttctgtgtcgcctccactgctgccctggcccccgggataaccaccccgaggattggaacgtcaaattcatcgcggaccgcgtccagcgccagtgcactcgccgtattgcaggcaatcacaatggcttttacctttttgtttttcaaaaaccggatgatctgctcggaaaagcggataatggtattctgggacttgcttccgtacggaacgcgcgcagtatccccgaaatacacgatattctcattcggaagctgtcttatcatctcccgtacgaccgttaggcctccaacgcccgaatcaaacacaccgatcggcgccgtttttttacattccgcactcaatgtcactcgtctcctagattgctaatacttttgcaatttcatactgatgggcgggaatctctttcttcatggagagagcttcctcgatatcatagtctacaaatcttccgttcttatatccgactacccggttcgtcttgcctgagcagagcagctctaccgccatggctcccatggtggatgcatatactctgtccttacatgtcgggcttccgccgcgctgcatgtgtcccaggatcgttgcccttgtctcaataccggttgcctcttcgattctcttcgccatattgatggagtcgcccacaccctcggcgttgataatgatataattctttttaccgcgttttttattctccataatgtcggaaataagggcttcctcattataatctttttcttccggcatcagaattctttccgcaccatttgcaataccgcaccacagtgccaggtatcctgcatctcttcccataacttcaataatgctgcagcgttcatgggatgtggaggtatcgcgcaccttgtcaatcgcctccatggctgtgttgactgcagtgtcaaatccgattgtatagtctgtacaggcgatatccaggtcaatagttcccggaagcccgattgtattcactcccagatgagaaagcttctgcgcgccggcaaaagaaccgtccccgccgattaccacaaggccgtcaatgccgtattttttacagatagcagccgctttctgctgcccctcttccgtgcgcatagcctgacagcgtgctgtctgaagaatggttccgccgcgctgaatcgtatcggatacatcgcgtgctgacaggtcgataatctcctctttcaaaaggccatgatatcctcttctgatcccgcgtaccttcagccctttggaaagtgctgttctcgtaaccgcacggatcgccgcattcattcccggagcatctccgccgcttgtgaggatcccgatggtgcggatccggtcttcaatctcttccaggtttattttactaaccgatgcttttgtttctgccatatttttatccacctttctaaaaatacctacctaaccaaatgtcgtttttccgcaatttcctgaacccttgccatcgggagggcgaaaaagcctgccctgcagggattgcttaaattttaacactttgggtactattctaacctatttataaatggttttcaataggtttttctaccacttttacccgcttatccccaaaatggttcatcaacctgcttaacacctgagggccgatactgatattacggtttctcggcagacgcttcaccgcccgttccgcctggcagtagatcacgacctcatcatcgccctccgaatccgcaaggtacccgtagacgatctgctcttcttcctgaaatgcgttcttatccgggaactggagccaaagctctttctttgtctgtgtaaacggaatgatcttctcacaaatcagcttactcgccttttcatcctcctcagacactctccctcggataaacaccttattatccacttccaacagagggcggttcttctcataatcccgcgggaacaccacaacttccaccgttcccagcaggtcttccagtgtcaggaacgccatcatctgattattcctggtgtttttcaccgtcttgtcagtaatcattcccccgataatctctttggcgccgtcacggaccttgggtgtccctgtctcctcatccggctgaaaatcagcggttgtggcagaaatggacctgcgccacttttcctcctcttcctccagcggatgcccgctgatataaatccccagcacctctttttcaaaagcaagcagattctctttcgtatactcgcctacatccggcagtttgatttcaaactcgctcttttgctcatcatccaccagatcaaacagtgtcatctgcccggtcatggcatatttcttttcctggttgacatggtccacgatctgtacgtaaatgctcatgaactgttttctggttccacccagcccatccagcgcccctgccttgatgaagttctcaattacccttttattgagggaatccttcacggacattctgctgataaagtcttccagatttttaaacggcccgaattctttccgatcctcggcaatcgcttcaatgacaggctttcctacgctcttaatcgcagccagtccatagcgtatattgccctcatccacggaaaagtcagccactccgcggttgatatccggcggaagtatccggatgtccatctgccggcaggtatagatatattctgccacctttgacggattttcaatcacggaagtcatcaaagctgccataaattcaaccggataatagtatttcagatacgccgtctggtaagaaaccaccgcataggccgcggcgtgggacttattaaaggcgtatttcgcaaaatcgatcatttcatcgtagatcttattggcagttttctcattgatcccgttagcaacacagcccggaaccccgctctcttcgtcgccgtagacaaaggtctggcgctccttctgcatcacatcgccctttttcttggacatggcgcggcgcagcagatcgcttctccccagcgtatagccggccagatcacgcacaatctgcataacctgctcctgatacacgatacacccatacgtcggcgcaagaatcggttccagctgcgggcagtcgtaagtgattgatcccgcatcattctttccccgtatatactgcgggatgaagtccatgggccccggacggtacagcgagatcccggcgataatatcctccaggctgtggggtttcagttccttcataaagctcttcatccccgcgctttccagctggaatataccgtccgtcttccctgtgcctatatagtccaatacgttcttatcattatagtcaatccgatccatatccagttccgggttcttatgccttaccatcccaaccgcattctgtatcaccgtcaaggtgcgcagccccaggaaatccatttttaaaaggcccagctcctccagtgtggtcatcgtaaactgtgtggtgatggaaccatcctgcgcacgggacagcggcacatactcatccactgacttctggctgatcacaaccccggccgcatgcatggaactgtggcgcggcagaccctcgaggcgttttgacatatcgatgagatacttcacctgctcatccgtctcataggttttccgcagttccgggttcattttcagtgctttatcaattgtgatattcagttcggtaggaatcatctttgcaatcgtatctacaaaggcatagggcagatccatgacgcgtccgacatcgcggatgactccccgggccgccagggttccgaatgtgacgatctgcactacccggtccttgccatatttgcgtaccacatagtctatgacttcctgccgtctttcataacaaaaatccacgtcaatatcgggcatggatacacgttccgggttcaggaaccgctcaaacagaagctggtagcggatgggatcgatgttggtaatctccaggcagtaggacacgatacttccggcggcagagccccgccccggacctaccgcgattccatgatccttcgcatactttataaagtcccacacaatcagaaaataatccacatatcccatattttttatggtattcagttcatattccaaccgttccctcagttcctggggcggctcgtcataatgtctctccaggccctcgaaacacagcttattcagatattcccaggaagtcatgccctccggcacatcgtatttcggcagcttggttacgccgaattcgatctccacctcacatctgtcggcgatccgctgtgtgttctccagcgcctgcagcgcatagggaaagagctgcgccatctcctcgggggatttgacatagtactgtccgccctcatagcgcatccggttctcatcatccagctttttcgcagtctggatgcagagcaggatatcatggggcttctcatcctccgcgagagtatagtgaacgtcattggtggcagcaagttcgatatccagttcctccgacatctgcagaagcctctggttcaccagcgcctgatccggaatgccgtgatcctggagttccagaaaatagttccctttcccgaaaatatcctgatattccagggcggacttcttcgcctcctcatacagtccttttgtcagataccgctgtacttctccggccaggcaggcgctcagggcaatgattccctcgtggtattccctaagcagcgccttatccacccttggcttataataatagccttccacaaatccctttgacacaatcttcatcagattggcataacctgtattgttctcggccagcaggaccaggtggtaatacctgtcctcgccgccgtttacttccctgtcaaaccgggaattcggggctacatacacctcacagccgagtatgggcttaatcccctgcttctttgcctcccggtaaaaatctatcacaccgtacatcacaccgtggtccgttatagccgcgctgttcatgcccagttctttcactcttgccacatattcttttatcttgttcgagccatccagaagactatattctgtatggacatgtaaatgtgcaaaattcattcttcacctcttgcttctatctgcatccgtgcagacctttccactgccgccgcggtcgtctctgccgacaggccttcttttgccgcggagcagaccatcggatcccatctgcttcacagagtgaaaaagggcggtcccctgtaagagaactaccctcatatgcttcctttttatgttgatccaggaccgccggcgcccttgccggctatcagggactcacccgttactgttcgcacccccagggtgtgaatagtaacactccccttgcggttcttctatactccaccgttgatcataaaattgatcagtctgtctgtatcttctttttcgtatgcaatgatctccaattcaggaatctcgccgtttgagaagatgttcgccatggatacatactgggataacttagacttcagattcagtctgtccccctcgcctgttactaattctactcttccctggcatgcatctactaccttaaaaaatgcctctatgtccgtaatattctgtactttcatctttacaatctctcctttcattcaactacgtcttactgtttcattataacttatttcaaagggattgcaagattttttaacgaattctgatgcatttttccagaatctcaatcttacctgcctttaaaagacgtcccactgcacgcttgaacgctgccttgctcatattgaattcccgcttaatcgtctccgggtctgctttgtccgtaaacggcagttctccatcatagctttggatcaccttaagaatgtactgagcatctttatccatctgctccggaatcttatcttttacgctcagatccagtttgccgtccgccttcacggaggtcaccctggcttccaccgtctggcccaccgtcagaccgccgaatacgtcttttcttggaatcagcgcggaatactgctggtccaccgctacaaaaattccgaactcatcactggtatcgtagataatgccgcttaccttgtcatccttcttatacggagaatccgtccgcagcatatgatagactttcatagtggcacaaagcctgctgctcttatcgatgtaaagggttacgaggcattggtcacccttttttacctttgccgtctgttccttaaaaggcaggaataagtctttttccagcccccagtcgagaaaagctcccatcttccccacatctgccacttccagtatcgccagctttcccagggtcaccttaggttcatgggtggtcgcaatcatccggtcgtcagaatcgcggtacaaaaacacttcaacagggtctcctatctcaatgtcccggggcacctgcttcttcgggagcagcacccgctcctcatcgcttccgagatacactccgaactctactttctttacaaccgtcagaacctgtttttcccctaacttcatttcctgttctccttctatctatatcgggacatgattggtcggcctgcccctgtttctaacactgatactatgttagtataccttgtctttcctgatttagcaaacattttcccgatgttcttgactattggctgcaggctattataataagacacaatgacccgcactctttattgtatatcatcatgaaaggatcgatcccatggataaaaaaacaaatctgccttctacacgataccatagagcggttaatctgctctgcattgccgcaatggccgctgtatttctctatctcattataaattgggatcacatcccggaccagattcccggacattataacggtgcgggtgagatcgaccgctggggaaataaaagcgagctgtggttcactcccattctttccgtcctcatgtatctcggcatctctctctgtgagcgcacgcccggcatctggaacacgggcgtcgaggtgaccagagaaaacaaggtacgcattttccgcatcataaaaaatatgattgttaccatgaaacttgtcatggtgcttacgtttgtgttcctctccttttactctgccctaacaaaaccgcttcccgcctggttccttcccgcagatatgattttggtgttcgggcccatggcctttttcctgatacagctctaccggaaacgttaagactgcgagctctttgacttaaactcgatcaccgcgtaaggcttctcctccctgtcacatagctctaccacggtccgctcggcttcaaaagcggcctttggatagatggtgtcgccatagactgcggattttttatagtccaccctcagctgtccgatcttcatatcttccggaaggatttccagcgccatctgaacatactggcagttattgacatgctcgttggtatcgatatggtatttgcgcaccggaaaggatggcaggtttttgcaggattccggcagttttatctttctgtcctcatagtgcatctccagcggcggctccataccgtaaggcgcgatatcttcctcccccggccttgccggccggcccttctctatatccatgaatacccatacggagttggcgcaggcagtcatatttccctgttcatccttcatgacaaagttacggttcccgtatagtcccttgaacccggtggcaaatgtgcctaccgtaatctgctctcccattttcggaaagcggtcgatcaccacctgccagtaggaaaggagccatgccttttttctctctctcaggacctcgaggcccacgccgatgtcttccgactgaaaggtgctgcagtcctgaaaatagttgataagcgccggaagtgtcatggttccctggtggtcgatttcgctgtatcttactctgctgtcaaatgagtacatttataataccttctttcttatcctgtcatttcactgttcgtgtttcttaatcatttttgctggatttaaagctatgttccattgtgatcacgcaccggtaacggtgatccgtctccctcagccttgccgccagttttgcctgcagctcccgccgctttttttcatggtaagagataggcactaccatatcgaagatcagattgatctgctcttttccctcgaccacgcggaaatcatggatactgcaactgctgtccagccctttcaacgccccgtccacctgcatgcgtattttcatgacttcttcattctgcgtttcgatcggatccatatggacaaccaggaagatacccagttcttctatggcatctctctcgatccggtcaatgatttcgtgggactcttcgatgctgacattgttggggacttctgcatggatcgatgccatgctccggtttggcccgtaattatgtacgattaggtcatgcgtcccctcaatgccctcatagttttctacaaattttcgaatcttatcatacagctccgggtctaccccctcgccgatcagcggctccagtgtgtctttggcaattcctacgcccgcccacatgaccacgagagctacgcctactccaacaaagccgtctatattaatgccggtcactttgaaaaataccagagaaaggatcgttgctccagttgtgatgacgtctcccatagagtccgtaaatacggccatcattacttttgagtcaattttccgtcccagtttccggttaaaaatgcccagccacagcttgacgccgatagacaacagcagaatgatcacggacaggagctgaaagttaagttcctccggcattctgattttagccagagaatccttcagaaatgtgaatccaacttccaataccagaaaggctacgacaagagccgctatgtactccactctgccgtggccgaacgggtgatcctcatcagcaggtttccctgccatttttactccgacaaagctgatcaccgacgatcctgcgtcggaaaggttgttgaacgcgtccgctgttacggaaacgctgtgaagaacgattccgacaacaaattttacaatgaacagaaatacattacaaaagatgcccacgatactggctaatacgccataagctgtacgcacggacaccttttctactttttcataatcttttacaaaatgttttactaaaaattcagtcatgttccctccgcctggatctccggagattccgcctgcacattcgggctctgtgccgtccctgtgacgccggccgttctgttatttaaaacgctccaggaaataccattttatcttaaagtctgattgtgccgtcacctgggagtattcgtcctctgtcagcacgctcttcaattcctctttaccttcttccggcacaactgcatttgtggcatccgtaaagcacaaattcgggtacagtacgcaccaccagttatgtccttttgctgcgccgatctcaattcttaacgcttcataattccccgccggaaacgtcacatccccgtatgtcttatccgggaaataacaggtcgtcaccgcggcgctgacgggatagtctttgttttgcgccaagatcgtctgtctggcagtctcttccagttcatccgtatgcctgcgcatccattcttttgtttcgtccacattcatcccttccggcattgcggctttcaggtaggccagaacctgttccttgacatccattttcagggcctggtcttcctcactgtcgctgtttgcaagaatgtgaaaccgcagaacctcctgagccagatgttcctgcgtcttggcctgagcggtcagctgcacacgccagacggcaaaccccgtaatcagagtcgcgatgatgaccgcgagcattaaaataattctgtttgtctgtctttctatgtgaaatgtacgatccatatgtaactccttccatgtttcagatgtgtcagatctgtttgataaaaggagtattgacagaaatctcagaattatacaacaatggaactgtcgggaaatgaaatctatatacaagatatttttgcaggctatgcggccaaacagcaatatatagtatatataatttgttgtccgacaccgccactgtttttatacttatttatgacgcagtatatcggtcaccgccgccacctggttatcgatatgctggcttgtgattttcgcagctttatctctttccccattctctatggcccggataatgtcctgatgctccgccagaagcttagggtggcattctttttgcttcaggtactccacacggtaccgatacatctgttcacgcaggttgttcagtagctggatcagccttgtattatctgtggcaatatagatcacgtcatgaaacgctacgtctgcctcggcaatctgggtgatatcatcgctgtccaggacggcttcgaattccttcgcagactttttcagattccggattccctctttgtctatccggtcgcaggccagctgtaccgccagctcttccagggcccctcttacttccaagacatctcgcaggttcttctccgtgatttccgcaacttcggcacccttgcgcgggatcatcagtacaaggccttccagctccagcttacggattgcctcacggatcggtgtacggcttacgcccagcttattcgcaagctggatctccatcagacgctctcccggctttagctcgccccgcagaatggcttgtctcagcgtgttgaacaccacatcccgcaaaggcaggtattcgttcatagtcacttcatatttaggctccatattctatcctcctcgcaccgtgtatgttcgtcacatacacctgctttgccagtgctttttctctgatcttatcctgcgcttttctggcctgcgccttgttctcaaacaggccgaatacggtcgggccgctgccgctcatcatcgcgttgagcgctcccgccgctttcatttcattcttgatatcttcaatgaccggatacatggggatcgtcacatcctccagcacatttcccatggcagctgcgatgtccggaaggcttccttgttctaaaccggctatcagggcttcgatatccggatgttttaggatctcttttgcatccagcgcctcgtacacgaccttggtggatacactaatcgccggcttggcaacaagaaccgtgcatctcggcatggcaggcagcaccgtgagttcttccccgatcccctctgccagtacggtgccgcgcatgatgcagtagggcacatccgctcccagcttcacgcctctttccatcaggtctttttgggacaggcccaggccaaacatccggttcattccaaaaagcacggcggcggcgttggaactgccgcccgccatacctgctgccaccggtatatgtttatccagcgtaataataacaccttcctgaattgcaaactccctgatcatcatagccgctgctttgtatgcaatattattctcatccgtgggaagaaaatacagattcgtcctgacctcgatccccttcttttccgtccgctctattttcacatcgtcatacagatatattgactgcatcaccatgcgtacatcgtggtatccattcgcccttctccccagtacgtccagtcccagattgattttggcaagcgcctttaatgcgatctgtttcatcctgtgtcctccaaattgtatcttgtatacattatacctacagtatactcatattttctttaaaaatcaacaatttgtcacccggttttatggtatctgattccaattcattgatttccttgataccgtctatggtggtcatataattctttgcaagcgtccagagctcatctccgtcttttacaatgtagcctacgattcccggccgtttttccatctcttccatcgaaaccggggacagctccacatccgtaattacctgcatgggaacgggcttgcgcataaatgtatcaaaggcaagcacagccttcacctctaccgcctcacttcctgccagattgacggaaagctgctctacatgataggagatgttatagcgcacatcttccgtcattcccgggcattccaacagataggagaagggcaccattccctgccagcccccaaacggcattgcatcatccgctttcagataaaggaaggaaatgtgcagaatgccttcgatctggattccttcctctaccagctccatgtgttcgatctgcacgctgccgtcgctgtggcagatctgcagcacgtcgtcttttagctccggaagggatagacgctccgctactttacatttcgaataattctgtacaaggagttcttcatagaccgcctctctcgtctcaaatccgcagttttgctccagggagtacatatcctccagaagttcgatttcttcctcctgataaatgttcatcctcaaattcagagtcccctctatcccaagaatgcgcatttccccatcctcatccatgcggacatccatcagggtatcctccaggctgttgtggacataatagtacatgccttcctccacgccgccgcattcgatcctgccttcatacgggacgctctgttccagccagtctgccttcccatcctcagacagatacatgcagaacaccaggagttcccctttcagctgcatctcatcctgacccaggcggatctccagcttcctgctgctgacgtccgtcaaaagcagctgcccgacgctttcctttgttccaggaagcgtaatttcttccttgatccggtaggtgtcctttttggtggtatgaagctccaggaggtttacatttttcatttttttgtaaatcggaaccgggctgtcgatatccactgtggtttcttcgtcctccagcttttcccggccaatctccatctctaccattgcacggatactcagttttctggaatgtaccagagataccgtgaattccacgcggatattctgtataaaatagctttccatttctccgccatccgtatacaccatctcttcaaatggaatcttgccttctaataccgcgggctgcggatctccagttgcagtgacatatagtatctgaaaatacaatttgcccgaaatccttatgtaattctcaaccagcttaatatcctcaattttaaccgtgccgcttccctggataatctgctgtacatcctccttcgcatcggggacattgtaatcctcatccagataaaactggtcaaaagtccgttttccctcctgtgtgtagtgcacctgtttcttaatcagttccatatacatcctcctctaatcaaaaatcacatttttttcaatatattccagtttgactaccacatagggataggtagttacctcttctgttttctctcccttttccggccccagcagattcgtatgtatataaatggcattttctgtctcataaagtcccgtcacttctacgctgtacccgcttttgggctgcggcccgtatccttccgcaatatacagatacccctggtctgcgtatgtcagcttaaatggcaggtccctgttttccagaatcgccgtcttcagttcatttggcactttctccttatccataacggtaaaatccaggtcccgcagcttttccgtcttttgtgggcgcgatatgcatcccgtaagcatcagcacaagcaaaaatcccgccagatacatcatttttctcttcatatccaatccccgcggtatattctctctattatcatattattcaagtgtcctgaatattctctttctgctggattctgtgccaaatgcttttttgggggaaggttggcttatggggaggcatttttacgagggcggtgtattgattcgtttggtgggatttgtcatctgtatagatttattgataaactgtatgttatttgaccgaagtatggatagtaacaaactagtattagacaattactagttactgttctctgggacttataccatactgtacggctcataagccgtgaataatgttcaaactaattttttacagaattatattctgtacattacttgttttttgaagcggctttttgtataattggagggtatggtattctggattcggtacgtgttaacaccggtttgagaaatacatagacaagaacagaaaagagggtatttcctgatgtttagatttatctgtattgtaatcttcctggttacatttttaattctttccattccgatcttcttcgtggaatgggtgatcggcaaattcaaccgcgaaaaaagggactacagctctcttcggctcgtgcagtgggcatttaaagttatcttaaaaatgacgagcgtccgcgccaccgtcatcggggaggagaatgttcccgacgaaccggtgcttttcatcggcaaccaccgcagtttttttgatattctgctgacctactcccgctgtaaaaggctgaccggatacgttgccaagaaagagatggagcacattccgctgctttccacatggatgcgctatctgtactgcatcttcctggaccgcgaaaatccaaaagaggggttaaagaccattctacaggctatcgactacataaaaaaggggatttccatctgtatctttccagagggaacgcgcaacaatggggaagaactaagtatgctcccgtttaaagacggcgcctttaagatcgctacgaaaacaaattgtgctattgtaccagtatccatgaataatacatgtgccattttcgagaaacaatttcccaggattcgcaaagtccatgtcgtgatcgaatacggaaagccaatctatccagatcagctggaaaaagaagataaaaaacatattgggaattacgtacagaacatcatacaggaaacaattattaagaatgcagagatcgtgtcataatcaattgaatgaaattagaggtgctgtcgtcaacagcacctcattattttcagagagacttcggaggggtctgacccttttgcaaaggggtcagacccctctgcgaattttttcgaaataggcaaacattccttctgctatgaccgggtctatcaccggcagccccgttgcttcttccagctcttttgccacgcctatggtgccaaggcctgtgcacgccagcgctataacctgggcgccctgctctttcagctctattccttttttgatggtattctcccgtccttccggcgtcatcaaatccagcgtgctgtcgactccgtccggcttaccaagtatcatctttccagccagcatcctctcataagccttgggtgcatagtcggtgatgcccagcacgcctactttatcgccatattttaacgccagggccaccgtagtctcgcctccgccggtaaccgggattcctgggatcgcctctctgatttcttcaacgcccggatcgtctgcacagctgacgataaacatatccacgtctgtaaatgttttcgctgtctctacaatttttggaatggccagttcacataattcgtcgttatgtattccctcgtattgatccggaatgcattttgtctctacatcaataccagggaaattttccataattactttgccgtgtgcctgcagcacgtcctggtcttctgtcgtcaggacgcgtattaatcctaccttaaaccttcccatgcttcttcctcctcaaaaagcgggcgtgcatcagaccggttctttccgccttcagcgctcccgccagacttatccttcccgcagcttttcttaaagtgtgtttgtaaatttgccctcctttatcacctgaacatcatccagataaagggtgggtttcaatatgattccatccatatggcactctgccttattcattcccccgaatgaagtgtttgttccaaatgcaatatgaaccgttccgtataccttttcgtcttccagaataataccattcaaaatggctgcctcgttggttccgatccccagttcacagagagttccgttggtttcatttttgagcagtacctccaggttttcacttttctcccctgtaacagaccgcagttttccgtccgtgattaccatatgaagcggggcatccagcctgccaatgccaaccatagaaccgtcaattatcatttctccgtcagaaccgtcctccaacggtgcgatatacgcctcacctgatggaagattcccgcattttccaggcgctttatagacaccggggcttggcactccatcacggcctttcaatgaaattgtcaaaacctttccgtctttttctatgcgggccgtgtcagccctggtcagcattgcagtgatcttatccgtcagtttttcaaccttcgtatagtctgcagtcatcgctcccttgctgaacatctctttcgtgataccaggcatcgtcgcgattcttgtgcccgctgccgccgcctgaatccgggcgttggtgtgcgtcagtgatttcgccgtcggtgctatcacgatatcggcgcctttcattgcttccgctactgctttgggcggctcctccccgcttagttccctctccttcatgaccagcatcatgccctcgcaacccagattcttggatgcctcgtaaagcgcttccccgatttctctccggctgtcatccgtcacaactaaaacagcctccccggcttttgcatccagacaagatatcaggacgccctccgctatttttactaattcactcatttcttctctgtctccctgtcttctgatttattccgcagcatcagtcagttcagataccacacgcgccaggagtgtcctcggcagaactaccatctttttcgtcttcctggcaaacatctctttcatttcctgagtatacccgatacagtccagaactatgagatcagcatccatatcttttacttcatcggcggccttttccaaagtctcccaatcgccgtacggtgaagccgctacagctttcacttctttcacatagtgtctccacttctcctccgtctgctcaatctgaagcggagacggcgtcatacagataatactggattttttgctcatcagaggaacaagcctgtccagaacctcgcaaggataaattacaggtatactttttgttgtaagagtctccgggaaactgccggtgcaaaacatcataatcagacggcagccctcttcctccatcttattcatcgcctcctgaagcctcgggagaatatggcgttctgcaaacgtcacagaactcccgtcattcagccgggacaccagtacatagtctccctccccgggagcaaactcagcaatgtcttccttcgtaaggccatccagtccgcccgcctgtatcagctcagcttttccgtcaaatatatccataatatcgacagtcacatccaccctgggggcctgtcctatcgtaaccgcacctatcttcatccagtgcacctcctgcattatataataacttcgcatctaaattttaagaatattctgaaaatggactgcaaaggggtcagacccctttttactctgctcccagcgtctgcagatgtttcatcggtccataaagtttttggatccgtgcatactcttcctcgtcatagaatttgcattgtccgcgcccaaatgcctttgccgcctccagcatgaatctcgccgcttcttctacgtctgacgcatggcttgccccggtcgcgcatcccggcaccatggtctccgcggtgattgcgactcctactacaggagcatttgttgcggtacatggctggagtacgctgttcaggtggtgcagatcattgccgtaaggcgtgatgtcctgggtcgccagcggaaatacatatggcagcctgccggttgtgatctgcatcaggtccagcagatcctcggatgtgcggagaatatacccttcttttacggttggtgagattgcgaatcctcttgtattgatgacgcggttgccttttgttgtgtctactgacaggatggcgtccagctcgtcggatacttcttctctgtttacctgggacatttcaactggtgaacccataaaaggcacgggatcatgcggtgcagtcggcgcgttcggacagatatgggtggaaataaatacatccccgtccagcacatcccctttgttctgcatatccagaagtttagccgcaagggcaactgctgcaagggcaccgtctccatccgatacaaagccgatgcgctccggacgtgctccaatcccgcccagccggccaagaagaccaatcgtcggcgcactgccgccctttatcttgccattgcttcctgggattctgaccttcagcatatccgtagtccccttgggtcccttcagctcatatacggtgatgtccgcatcaggctgtattgtgcgcagatactcctcaactttcttccccgtcacataagcactgtccagtacctcgtaggcatcgataatttgtttcattaacataaatttgtcctccttataatatgaattcttacttctctgccgctatgctgccctagtataagtcaatctaaacaccttactgttttactggcctgattttccgataacacagatacaaaagcctcagcgtagccccactacgccagcgtttttacatctgcactcttggaaaatcattttcaccgaaccagcaaggcgattagcttgtcttatactagatatgataccaggtttttcccaatcactttttccgtttcccgcagaagttccggctcaaacatcgtaggcgcgagcttcagattctcccggttggccgcaatcacataaacgtccagaccagtttccatcatggccgttgtcacaggctcgccgctcacggcattgaccgtcataataagatccgggaaggtcgccagacgttccccgtctttctccgccgtcgcgtattcattccagaaagtcagttcacatccatccaccgaggcataccccacgtcaaagcctcccgtggtttctatcgaaaatgcatctacctttccctttgccagaatccttccgcccagaaatccgcacacattttccacagctgcctccaccgaatgctccaagccctccaaaaatgctttacctgtctcaattgcatggctgacaccgcccagcgcacagttttccctggcataggaagccttcaccggattcctcgccacggccacaagtccgccggcctcaatggacgccatacgcaccagccgggacgtatgctcaatcgtcccttcaaaataacattccacgcggctgcccgcctccggattgccgcccgcacatgcctgtacggtccgatagtccgcctgcttgtgcagattcatgcttcccatcacgccagtaggatgggcacggccattgcagggggcatcgattacagggagccccagtaccgcggcctgaagccagccattaacagtcgcctctccaccctgttcatttgtgataatgccgccgaccgtaaagtcacaattcttctttaaaatctccaccgtgcggaccagatcctttgcggccatatactgctctgcagcattaggcgctcccacaagagaagccgtcagcagaacagcatcctcatccacggcctcaatgggaagcaggcgcagatcatcataatccaccgcaatctctgcgaacttcctcccctttttcgcatctccgccgcccccgccgcctaaaatcgttccgccggcaagcgctgcatccaaaagttcttttgtcaaacgaattccttttttaaccattcccgctgctccttcataagatataagccaatgcatacatctcctacattggctctttctatcagtataacacgtcaaaccgctaaagtccttattcaccggtaccgaatctgcgtctatcttttgtgcacagtgcacaatcacatgtattctttcaccctgcaggcaaaccccagttcctccagctgtccggcatcactcaggtcacaccccaaaacctcctcgatctggttcaggcggtaagacatcgtattccggtgaagatacagcctttccgcggctgtcttgcgcgagccccggcatgcagaaagcatctccagcgtctccgccagatggctctcatgttcccggtcatagatctccagggccgccagcttttcctgtacaaatgcccgcacttcccgctgttgtgccatatgcatcacaatctgctcatatctcagcttttccacccagaggacatttccggacagcccctttttttcccggatacggaaaacatcttttacatccttataaaccgcccccagttccagataatcgtaaaactgctgcgataccccggctgccactcggtacttcaacatgctgcagatcttttcaaccatcgttgaacagaggctgtccgccttttcctcctccacatccttcataatacagatgtactggtactggcgcacaataccggccccccagatacctgcccgctccatggcccctttcatcatctggtaaatgctctccatatctttctcctgagcggcagccatacgcggattctgctctgtctgaattaatatcatacgcagcggtgggaacggccagctcagagaattcacccgctgctccgcttcctccgcctgtgtaattttgccgctctgcagatccaaaaataacttcccgttcatctccatctggctgtaagtgccaatccggtaccggctggacatctcgagctgatttctcgcctccacgatcgccgtcataaccggatacacaacctcaataaacccgacgtcattattcaggaaaaaaagcggaatctcacactcatcagccagagccagggcttctttaggaaattcatcgaaaaaccgcgtcttgatcgccagcgccgatgcattgacctcccgcagatcccggatcagattcagcagcgcctttttgtcattgcggatcgcatatcccgttgtaatcaccaggagattctccctgagccagggtttaatatccggctgctccatcatatcgtaaaactccacaatccggtccagtccccctctgcctgcgacaagtgcggcaaatctgtccttccataattcttctatatcacgcactctgatcttcatctgtactccttaaccttcttttgacaggcaaatcctaatcccgccccgcagcgtgtataataattcattgctgcaaactgagacggcatcttacgccaagctatttataaacacactctaaaacgctgtattcaaaaacagcagtggcagtgtcaccatgcagagcagcgttgttaccaccacagctgcagaagcataatcctcatttagcttgtactgtctggcaagcatactggaggaagtcatagtgggtgccccggtaatcaacatcagcaggagactctccatctgcggcagaaaccgagatgcaataacatacacaatcaccggcacaaccacaagcttgcaagcggccagaagcagtaccgatctataccgcaatataccgccaaatttcataaagccgatactgcaacccaggtaaatcagcccccaactgtagctcgtatctcccacagcggttacaacatccatcaccagtgccgggaccggaacagaaaatgtggtcagcgccagaccaatgaaaatagaaataaaaataggtgtggtgactaccttcttgcagatattttcccgtctcccgctgcggccgagaaacaaaagcaggcccagtgtccataccactgccgtatccacaaccgagcagatcggtatatacttgtcccctcccgtctcctcaaacagcgccaaaatcaggggaatcaccagaaacccaaaattaccgcccaccatacagccgcagaatacatttctcacggtacccggcagcttaaatatccggctcgccagaagtcccacacaggccagcaacaaatatgcaccgatctgccataacacaatccggccatagtaaagcagggaaaatactgtagtgtggttctcccagatcagagagacaaccaaagccggcagcacgatcttaattaaaaaccccgaaatagaagtcagcgcttccctttttacaacccctaacctggacgccaaaaacccgatcaaaaccaagagcaggaatccgcccattttgggcagaacaatccagaaatactccatagcagcataactctctttcctctttaatatgtaaaaccttctttagagtccactttactacattctacagagcgcttcaatgataaaaatttactttttccgatttattgctgagacctctgatagagccttcaatttttcaattgacactcccggcgggcagctgtcgctattcgaaagaatataccccctccctttcataatattcacaagttcagccgcttggcttacaacctcctttgttgacaattgtaataattgagtgggttctattcctccgacaatagaaatatgttccggtaatatattttgaactctttgcatttcaacatttcctgttggggccggcgtaactgattctaagacatctattttggagtgagcaatatcctccaataaagcattcaattccccacaggcatgttgaatatattttttatccttttggtgcaatatatcgcaccacatatttatctccggcaatatataatctctatagaattgaggtgaaatatttgtggtagatgtatcctcccatgaaaggaaaaactgggaggaggacccggctgcaatttctgcggcatctcttgatactctatacattgaggttaacgtttcctgcacaacttccggaaaatctactaaggaatatacgatagactccgttcctgcccaatgttctatgagtgattgaaaggaagacttcaattcaggacaaataatgggtaatagtaaacctctttcccccagcttttctgcctcccgctcaaatttttcataattagctttaagacaggtggaatccataatatacttcaaaagcaaaaagtccttttcttcctttataggatgatccactaaaaaccacgtattcccttcatttacaaaacgatatccaaatgtcaaatcaccttttgatgtatgatatgtaacctgtttctctttgccacacacttttgttcttatttcacaatcctctatatgcctgtcaaataataaaatattttcgctgtttttaccgtaaaggggataatatcccctaaatagtggatctgcccctatactttctaaaaattcaagctggcctttctttgtcagcttatcgtcctgggattcccaccaatatgccaaaaatggggaatatgggattctgtcacacttttttcctaaaagagcatttataatgcgttctctgcttgtcattttctcaccttaatctttcgttgtaaatgtttcaatcatatataaaatatttccggatgcacctacccttttaccgcgccggctatcataccggatacaatgtatttctgtccggctaaataaaccagaattaccggaaggcttgtcaacaggatgtctgcacataccaagttccactccttgaaatacatgccaaaaaaattatatatagacagcgtcatcggccatttatcagagctgcttaaaaaatacagcggtgatacaaattcattccatgtatttaaaaatgtaaggacaattactgttgccaaagccggttttaacaatggtaaaataattgatataaaaagccgtgttgatccgcagccgtctatgactgccgcttcatccagttctctggggattcttgctacgaatccatgtattaggaaaacagagaatggcagctgcatagccgcatacaatagaataatccctaatcttgtattgttaatatgtaaaaacatcataacttttgtcaaagcaacgtaattaattggcatcgtaattcctaacacaagatacatatagattactctgtaaaactttgacccatttctggagagaacataggccgccattgctgccagtaatacacagactgctacactgcacacagaataaagaatgctgttcgcaaaagaggcccctaatttccctttttcaattacattcaaaaagttgctccactcgattgaccccggaagtttcaaattcatgtccgatgctgcattgctgtttttgagagaattaaaaagaattagtaaaagcggaatcatacatactgcagaaatagcccaggcaataacgtttgtaagaatcgcacttagtttttttttcatccgcattattcctgcacctcatttcttgtcatcactcgaatcataaaatatccaatcacgaccataaaaacaaacatcacagacgacaacgcagtcccaattgcatattgtcccgtgccaaaacgtttaaatacttccgtatacagcacctccgtagtcgccttgccaggcccgccattcgtcagtgcataaaccatgtcaaaaacttttaatccatagattacattcaacactgtcgttgtcgtcagggtaggcaaaagcaacggaaacgtaatataacggaatttttgccatccgtttgctccatcaatgcttgccgcttcatagtattcagccgaaatggaaagtaaacctgccaccaaaattgtcataatataaccagttccccgccagatatcaactgccattaccgaaggaaatgcccaatccacagaagtcagccattgcattgccagagagtccaggccaatcatccggagaaaatgattcaaaataccgttcgcaggatctaatatagatgagaaaatcataccaagaatcaatgttgacaatacagaaggcataaacataatccctctgtgaaaattcaatagttttaccgcttttgtcattagaacggccagcgctaaaccaaatacatttttaaaaatagttgtcacaaacgtaaactctaatgtatttcctaatattttcatgtaattctcatcttttgaaaagataaccttaaaattgtccagccccacaaaatttaatttatcagaataagccgaccaatctgtaaatgaatatccaatacctatgattccgggtatcacaaataatacggagtatattagaattgcgcctatcgcgaatcgtattggataaagttttttcttattcatatctttatacctcgccctttaaatataggctggtaataaattaccagcctttttaaaacttatttccaagcttcatcgttcactgccgccgcctgctcgcttctcattttatcaatattttttagtaattcctccggtgttacttctccaagaaacattgccgataagtctgctccgatttgattccactgtggatttacatatttgaccgccacctgatatacggtatcttcttcagaatatctgtcatgaaactcctgaacactgtctaaatatccggagggcgcatttttaaatggcagtttattgaatctggccacctcttctgtcataaaagccaagctttcttctcttgccataaactcaaggtattgttttgcttcttcctgatgtttggatcctgaataaacaaatcttgtaggaccaaccggactcacattcaatttttgattgtctgctagaggcattacaaaatatccgatatcctcagcgtcaaattcagcatccgccgcattcacttcctgtccaagtccctgctgggcaattgtcatcgcatattctcccgatgcgatattttttgccgtatctacatatgcattagacatataattctgtccccagtagcctttgtctatcatatctttcatttgttctaatatggtcaccatggtttgatttccttcaaactttgcttcatttgcattcagcttttctgcaagtccaggctcggcagtctcagccgcaatagcgcattccgggaaccataatgtgtgatgccatccatccgatacgcattcatagattggcgtaataccggcatctaagatcttcttgcataccgcatcaaagcttgcataatccgtaggaatttcaagatccagttccttaaaaatattcttgttataggctactgcccaaacatttgacaagtcattcattggctgtccatacaatttaccatctgcagagatttctgccgcaaccagctcatcaacatttcctgcccatgattctccacttaaatcaacaccatttttcgcaatatttaattgtgtctgaatatcaaatttcccaccttgggatccaaagatatccgtacattctcctgtattgagcttagtcattagaaggcttgtatactgatcagctggaacaatttgataatccacctttatgcctgtctcttccgtaaattttttgccaagctcaacttctgcatcctgcacccagtcctggctggccataaacgtcagcgttacatcttttgagtcctcctcttttacttccttcgacttttcacttccgcatcctgccatgcctgccagcattgatactgtgattcccagtgccaacattttttttactgctttcattcgtatttcctcctcactttcccatcccatatctgagattttctttcatgtttttattatagacattgcgtttcctttcgtgaatgtaaatatcctcccttacacatgttatttttttacctctttacaaattgattttctttttctctcctttataaaccacttgaacttccgttactttttcacttgaaatcaaacgaatatgtaatctctcccgcactctcatactgccttctgcatttgccaaatacaagctcttctcgttatttcggtattccagccgcacgaggcagtactcacctatttcatatgcataaccgtctcctgcatcaaaatacatagaaaaatttccatccgctccatcatatacctctattacgttacatttcccttgtctctcatcggcatagtcaatatctccggatagcggtatgatcgcgccggcatggacgaaaagaggaattttatcaattggagtctcacagttcacgcattgcccgccctcatatttttcttttgtccaatagttataccatactgtcccttgcggcagatatacttctttttctttccttggacaatcacatgccttaccgcccgtctcataatacataggccgagttactggggaaaccaggaatgcatctccaaacatgtaactgtcctgaatatcccacactcttttatcctgcttaaaatcaaaaagcaggctcctcataattgttttgtgttctcttgtcactgctgcagcagatgagtaaatgtacggaagcaggcgataacgtagtctgataaattttagaattgcatcgtaaaatatggtccctttttggccaaaattccagggctcccttggagtatccgtcccgtgagaacggaatatcgggagaaatgtagcatattcaagccatctggtataaagctcacaatatgccgcgtctttcacaccgtcattgtaatcgccgtcccaaaaccagagtggatttggatctcccgccatattacatccacggttttcccacttatcccgtactgtgaagaatccgccaatatccagcgtccaatagggcattcctgtcatgcacatgttcagcccttcagcaatctgaattttcattgtagaccacttggcggtgatatcacctgaccacggaataataccgtatttttgtccggaaatataagtcgacctgctgagattgactactcgttttgacgggcactgtaatctccagtgttcataaatcccctttccatgccaaagcccatagctgttcacttggttccatggagccgaattatgtgcctccttcataatgatctcaaaacgttccttctcggatctttttaccgcaccgcaccagtcggatgctgtgaaaggctctgaattgtcacaccaccatgcgtcaatcccggcccggaaccactcttcactgcattgtttccagtaaatatccctggccttctccttatacgcatcatataaattagagttcggaagcagcattccatttttttcaaattctgaatgattctctgtccctgcatccatatttggccatacagacaccatcagcttaatatgcatgtcatgaagctgactcaccatcctgggcagatcagggtatctatgtttatctaccgtcttctgcccccattttttatcttcccaggtgcaccaatcctgaaccaggcagtctatcggaatgtcttccctgcggaaacgctcccccgtctcaagtaattctttctgagaactgtacttttcttttgactgcatatatccaaacgcccatcgtggcagcatggatgcgcgtcccgtaagttctctgagatgatagatgatttcgtcaaaatcatctcctaaaattacatagtaagacagttgttcttctgcataaatcaggaaggtcatcaatgtgtccttactttcaaataccaggctgctctccgtatctattaaaattccatagttgtctgtagacatcaaaaaaggaattgaaattttcatattattttgatacaaatattctgtttttcctttataattatatgtcccgttctcatgctggcccaggccaaacagcatctcatcctttgatgattcaaacgtcagccggatctgatgcatatatttatcaaatttttttacaccgttctttagtaccgttaccgtaccgtttgcgctttccacctgttcataaaccggtgtgccctctggcacaaaatgaaaggtttctatcttttggaactcacatcctgtttctcttaagcatatttgatgtctgccaaaacaaatttccttttcattccatgaaaccacattctctccctgattctgtgatgacgagatcccttccataattctgcccgccttttctccctttatatactgtacatgtattacatgcctgttaagttgttctatgcgcctcttccaacaatccattttgtccctccctcttgactttttatattttcacatttattctaaaatggcagcaataaaaattgaatgtataatctgactatttcacatgttatttttttacttatagtgaggaatgttaatcatgataagaagtaacaaaacgaaaattaaaacaatacaatccactctgatttttacatatttttttatgctgatcatcgtttttttcagtattatgctaatctttgcggtaacccaaactcagcgcatcaacaaagaatccttccagcttatcacacaaaacgtgaaaaatatttcttcatatctcgaaaacgaaacagattctttaaaaacactggcaaacaacatttcctattcctcattggtggaaaagcactttctgacatatctggaacacgacagtatggcctctgatactgacatggctgattatcatgatatccaaaatacaaaaatcctaattgatattctgaccgccataatcgggccagaacagcctgccagccagatttatctccattcttttacagaaggcacctttggcgtaggcttagatacaagcacttctcaggaatctattacgaatgccgcctggttccccctgttgaattcttctcctcataagaaaatatatctctgggaagaagctcctcgtttggcatcattctttagttataaaggcggagctgactgcctgtccttttataccatgtattacaaccagtacaataacgccattggaattattgaagtaaagaagacttctgccgagttaaagagaaaaatagagcacatatccagttcatacggagaggatttatatatttatgactcctcccaaaactgtgtatatacctcttctgctactccagcggattataacagcttgattcgtaaaccaagtcgggaaagtaaaaccgataccgtcattcatacctttcgaaataataaaaatgttttctatcagacttcggaaagcaatggttttacaaccgtgattgccatagaaaaaagtgatttatatgcgcctatttggtcgtatatccagaaaaatattttgatatttattgggttttcctgcattgcgctgctgcttgcttatctcgtttccaaatctatttccgcaccgataaagcaaatatattcgcagataaagagcttccaactcagccccgcttcccaaagcagagtctccgatctcgtttctgtgaacactggaattctcgagtttaatacactctatgacgctttgattgatatgcagaaaaaggcacaattatctatggaacacgaaatccttattcagaatcaggagatgcactcccggatgctcgcgttgcaaagccagatgaatccacattttctttataattcacttgcaacagttcagtccatggccgaagagaacatgaacgaggaaattatccaaatgtgtcagacaatcagcaaaattctccgttacatatcttctgacaaagaactgcttgttccgctaaaagatgaagcctaccatactgaaaactacttgaaatgtatgcagatgcgttacgaagacgacatagaatactccattgacataccaaaagaaatgatgtccatccgccttccaaaactttgtttacagcctcttgcagaaaactcagtaaaatatttaacctcttcagtaaaagcgccttggaaaatcaaaatagccggaagggttacaactacgtactgggaagtttctgtctcagataatggtcttgggtttactgaggaagtaatcaactctctggaagagcaaatcaaggaaatagacagaaccagcctgcttccatctcttgaaattaatgggatggggcttataaatatctatatcagatttaaactgttttataaaggataccatatcttccgcgttcgtaataatatagaaggcggggctaccattacactgggaggaagtatatatgacgaatcataagtttcctgtaatcgttgtcgatgatgaacggttaattgcaaagaatatcgcaaaaaatattgagcggtgcaactcatcttttcaagtcgtagccatcgctcacaacggagaagatgccctttcccagattcaggaacttagaccttcatttttatttaccgatatccggatgccggtcatggatggacttcgtctaattcaagaagcccaacataatgttcctttattaagatgcgtcattattagcggctacgatgattttcattatgctaaaaaagccatccaattcggtgttgcagactatttacttaagccagtcgatactgaggaactatccagtcttctaacccacttaaaacaggacatgctgtctgaaacagagcactttcatctgagtcagaatccaaaagactttaccaccggagaaattgtccagcttgtaataaattatatccaaaaaaactacgcctctcctttggatttaagtattttatcagaacatcttggtttttcctcatcctatctgaccaaaatatttaacaagcataaagggcttactcccagcaaatatattcgtaattaccgcatgtcaattgcacagcagcttttagctaattcagaattgcctgtcaatgacatagcacttgctgtaggttacacagatcctttccattttagtaagtcctttaaagcagaaaccggagtcagtcctacaatataccgtgaaaacctgcataacggaaaatagttgaaaagctttagacttgtctgcggatggaggcgcgaaataaatggatagccgcaaggtcaaaatttgcgtattgaacgccgtttcttgatactggcatggggaagaaagggaactgtcagcgcgtgatgcttcagaaaaaagtctgcttttcttttacttttttttcacatgtggtatactaaatgctgaaaacatgacgtgcgcctcgccgcggttacgcgaaggcgcacttgaatttaaggagattaatatgagtgctcagaatcttacattgctgacagacctgtacgaactaaccatgatgcagggatattttgaaactcaggaaaatgaaactgttgtgttcgatgtgttcttccgggacaatcccaataaagggggatattccattatggcaggactcgaacaggttatagactatatcaagaatctgcatttttcctatgaagacgtagattacctgagaggactcggaatattcaccgagaactttctgaattatctgagcgggttccatttcagcggaagcatttacgccatcccggagggttcggttatttttccaaaagaaccactggttaaagtaatcgcgcccattatggaggcccagcttgttgaaactgccatattaaatataatcaaccatcagagcctgattgcaacaaagacctcccgcgtcgtatttgcagcacagggcgacggaattatggaatttgggctgaggcgcgcccagggccctgatgcaggactctacggcgctagagcggccatgatcggcggctgcgtaggcacatccaacgtactggccggcaaactttttgacgtgcccatcatgggtacccacgcccacagctggatcatgagcttcaaagacgaatacactgcatttaaagaatatgcaaagttataccccaacgcgtgcacgcttctggtggacacatacgatacgctcaaatccggtgtccccaatgccatccgtgtattccgggagctgcgcgaggaaggaatccaccccagatcctacggcatccgcctggacagcggggaccttgcctacttatccaaggaggcccgcaagatgctggatgccgccggctttaccgatgcagtgattgcggcatccaatgacctggacgagctgctgatccacgacctgaagatgcagggcgcagccatcacctcctggggagtgggcactaacctgatcacctccaaggactgtccttctttcggcggagtatataaactcgccgcaattcaaaatgcagaaggagagttcatacccaagatcaagatttcagagaatacggagaaaatcacaaatccaggcaacaaaaccatctaccgtgtatatgataaagagacgggcaaaatccgcgccgatctgatctgttttgccgatgagacatacgacacctcagaagaacttttattatttgaccccaatgcaacctggaagaaaacaaggcttcccggaggcagctacaccatgagagagatcttaaagcctgtattcatccacggtgaatgcgtatacagctcaccaacggttatggagatcgcccattactgccgtcaggaaaaagagacgctctgggacgagactaagcggctcttctatccgcaccgcgtttatgtggatttatcccagaagctctatgacacaaaatcacgcctgctgaacgatttgagcagataacgaaacgctccgctcgctggtataaactcaatgaagataggagatttaagaaatgaagattatagtattagccggaggactcagcacagaacgcgacgtatccctgtcctccagtgcaggcatctgcagaaccctgcttgaaaaaggacacgatgcttttctgctggatgttttccttggtttcccctacgatccagatcgcctggaagaggtatttacccttcctgaccacggtctcgggatcgtcaaaaacatcgataccaccgaaccggacatcgaagcggtcaaagcctcccgcccggatcagccggactgtttcctcggccccaacgtcatcgaactatgccgcatggcagacatcacgttccttgggctgcacggcggagagggggagaacggaaaactgcaggctacctttgacctgcttggaatcagatacaccggtccggattctcttggctgcgctgttgcaatggacaaaggatttaccaaacagatctttctgcagtcgggcattgacacgccggccggagcctgcgttcataaaaaggcagcggaaaaatcactgcaggccctcggcctcacacttccggttgttgtaaagccgtgttccggaggttccagcattggggtatacatcgttaccacagagagcgagtacgaagaagcgctcagcagttctttccgctacgaggacgaagtggtaattgaagaatatattaaaggaagagagtttgcctgcggcatcatagacggaaaggccctccctccaattgagatcatacccagaacagggttcttcgattatgccaacaagtaccaggatggcgccacagaggaagtctgccccgccgatattgacgaagatactgcaaaccggatgatggagctcaccgtaaaggcataccgagccctgaagctcaatgtatacagccgcgcagattttctcctggacagcaggggaaatctctactgccttgaggtaaacacgctgcccggcatgacagccgccagtctactgccaaaggaggcggcagcagcaggcattgagtacggtgatttgtgtgaactgattatccaaaaatccctggaagccagataccagtaaaggacggtacgaacgatgaaaaatatgacattgaaggaaattgccgttgcatgcggcggaatctattacggagacgaggaaagctattacaaacaagtcacatccgttaccattgacagccgcaggatccaaaaagactgtctgttcattgcacttcgcggcgcccgggtggacggccatatgttcatcccccagtccattcaggacggagcgctgtgcgccgtttcagaaaagagaatcgagagcgcttcctacccctatatcatggtaaattcctgcgcccaggccctgaaggatatcgcggagcactaccgccgttccctccgcctgaaggtggtgggtatctcaggcagtgtgggcaagacaagtacaaaagagatgattgcctccgtgttggcacaaaaatacagcgtcctgaaaaccgagggcaatttcaacaatgagatcggactgcccctcacaatctttaacattcgggaagatcatgaggctgccattctggaaatgggcatcagtgattttggcgagatggaacgtcttgcaaaagtcgcgcgcccggatgtctgcgtcctgaccaatatcggctgtgcccatctggagcagctgaagtcccgcgaaggcattttaaaagccaaaacggaaatgtttttatatatgaatccggaaggggatatcatactcaatggggatgatgatatgctggcatccgttaagcctgccaaccatattgagcctgttttctttggcctgaacccggatctggcatactatgcagacgaaatagagaacctgggattaaagggtacggctgcacgcttccacacgcctgattccgaattccgcgcacatatctccatccccggggcgcatatggtatataatgcactggccgccattgccgtcggacgggttatgggcatgaatgataaggagatccggcagggaatcgaatccctggcgcctttggccggacggaaccatctgattgagacagagactcttactatcatcgatgactgttacaatgccaacccggcctccatgaaggcttccctggatgtcctcagtaaggctggcggacgcaccgtcgcgatccttggcgatatgtttgagcttggtccaaaagaacatgagatgcaccgtgagacgggagcattcgccgcagatgccggcatagacgaactgatctgcattggctcccttgcagaggacatcgcccggggagcaatggaagtgaatccggaaatgcacgtgcactattatgaaacgaagaccgaatttctggaaaacatagatcccctgattaacacaaatgatacaattctggtaaaagcctcccatgcgatggagtttccggagattgtcgaagtattaaagaagaggtaaatatggattatcaaatgctcgtgctggatctggacggcacattgactaattccagaaaagaaattacggaacccacaagaaacgctctgatcgagatccaaagagaggggaaaaaagtggttcttgccagtggacgtcccatattcggagtccttcctctggcagaaaaactgcatctggatcatttcggcagttatatactttcctataatggagcccgcatcacccgatgctccgacggtaccgatatttataacaaaaccctccctccggaaattataccagttgtctatgatattgcggcttcgtttccaggtgtggatcttctgtcgtataacaacagccatatattgtccggaatcgcagtcaacaagtacacagagcaggaatcctttcttaacaaaatgcccgtggcagagatccctgattttgtcggacacctgaatttcccggttaataagctgttggctgccggggatcctgacatcatggaaaagatgatggaagcgctgaaaaaacgttttcacactttcctgaacatataccgttccgagcccttctttctggagattatgcccaagaagatcgataaggcctattccctgcagaagctgctgaacagcatcggaatgactgcagaccagatgatctgctgcggagacggttataacgatgtatccatgattgaatatgccggtcttggcgtagctatggaaaatgcccagagtatcgtaaaggataccgccgactttattacccgctccaacgatgatgacgggatcctccatgtaatagaaaaatttatgaaagaaaaatgaggccgatcaaatggaattacaaacattttatgaaaatattggcgccgattatcaagtcgttttacagagactgcgcaaagaatctctgatcgataagtatctgcatcttcttctgaaagatccggtttttgaaactctggagcatgcagtggaatccaacgatcatgaagagatattcagagcggctcatacaatcaaaggaatggcacttaacctggaactgccccctcttacggccgcagcctcttctttaacagagtacttaagaacgttgtcccccggggaggcggacagctctgtggtaaaagagaaatatgtggatattgtgaaggaatatgaaactgtccgggatctgctggccaggttctgattagcctaaggagcaagtgaatgacaagcacagaacaaaagaaaaccattttaatcgtagatgatgcggaactgaaccgggccgtcctgtccgatatactgcaggaggattacaatatcattgaggcagccgatgggacagaggctattgagattctgaaaaagaatgacgcttccatttccctgattctgctcgatattttaatgccaaaaatgtcaggatttgatgtcctgacaattatgcagaagaaccactggcacgagactatccctgtagtcatcatttcatcggaaaattccagggaatatattgaaaagggttacgaatacggtgttgtggattatatcagccgcccctttgactcgaatatcgtccttcaacgtgtaaaaaataccatcatcctttactcgaaacaaaaggagctggaaggtctcgtaaaggagcaggtaattgagaaggagagcaacaacgctcttatgatcaatattctcagtacaatcgtcgaattccgtaatggggaatccgggctccacgtcatccgcatacgcattataactgagattctactggaagcgctgcggaaacgttatccggagtatgcgatggatgaatcccatattgcactgatctcgaatgcggccgctctgcatgatatcggtaaaatcgagattccggaagagatcttgaatagacccggcaaactcactgctgaagagttcgaagtcatgaaaacccactccgcacgcggagagcagatgctgaatgaactgcgttttggcagcaatgaggaactggtaaagtatgcaaggcagatctgccgctggcaccacgaacgctgggacggtaatggataccctgaccacttgaaaggggatgagattccgatcgccgcacagattgtttccctcgcggatgtctatgatgcgctggttagcgagcgggtatacaaacctccttatactcataaacaggccatgcagatgatcctgaacggagaatgcggcatgtttaacaacaggctgattgattgtctcaaagcggtcgatacctatctggagcatgcggtcagcctgcgcagccgggatcccgcacacgtattcaatatcaaccagctctcaaaggaactgtttcaaaaaaaaggtgtcaagctctccgaccgcacgctgtttcttctggaacaggaacggaccaaatatcagtttatcgcatccttatcagaagatgttttattcgaatatgatttcagtacggacacggtcttgttctctgaaaagtgtcaggaagagtttaattttccatctatcataacagattttgtcaaaaagagccggttatatggagtcgttgcgaaaaatgattttcaggaattgatggaacgtatagcggctaccacaccgttctctcctgtatttcagaagagaatgcttctgactactattagcgggacgcaggaatggtatgaattcattggccgcacgctttgggccgataatgaaggaaatgaagagctgtacagctgtgtcggaaggatatcgctgtcccggaatggaaaagaacggcagatacaggagctcccccaccgggacgctctgacaaatctgtacacacagacaacagcgcaaaaaattattgtgcagaacataaccaataatccgcagacaaccggccttatgatcatgtttgacctggataatttcaaaagactgaacgaaaaaaacggacatttattcggggatcagatcttaaagcatatcgcccgcctttccgaaaacaatatccgtaaaatggatatctgctcacggatcggcggagacaggttcctaatgtatttcagcgaactcttttcagaagaatttatccagccatactgtgcctctcttacgaaggctctgacgcagaagtataaagactccgaatacacggtcagcatgggagccgccatgtatccgcaggatgggactacatacgaagaactcttccggcataccagtcaggctctggagacatcaaaacgcagagggaaaaattgttttacccgttatcatgattctctttccacacagggtttttctccggaagctgtgccagaataattgcggcaaacaccaaggcacacccaaacaattctttcccagaaagtgtttcatgtataatcagccagccggtaagcgcggcaaatacggattccaggcttagtataagcgaagccaccgtggggtccgtatttttttgtgcaatgatctgcagcgtataggcgacaccgcaggagagaacccccgcatagagaagcggcagatacgcatccagaatactccccatggctggcttttcgcggacaaacatcggcaccgcgcagagaatcccgcagataaaaaactgtatgcaggagagcttcacgccatccactttcggagaaaaataatcaataatcaaaatatgtaacgaaaaaacaaaagcgcagatgatcatcagaacatctccataagctatggagaatccctctttcatacacaagaaatacatccccacaacagccagtccaacaccggcccaggtcttcccccctgcccgccggcccagaaaaagcccaagaacaggtacaatcaaaatatacagggccgtaataaacccggccttcccggcgctcgtatacacaagcccgatctgctgcagcgaactcgccgccgcaagcgcaagcccacagagcagacccccgatccagagcgtcttaccgatcctattcgcctcgtccccctgtacctctgtcccttccgtctttttcctcctgcccataaccccaataacaggaagcagcacaatcccgcccaaaaaacaccgcagagaattaaacgtaaacggcccgatataatccatccccacactctgagccacaaaagcgctcccccagatcagagcggtcagcacaagcatcacattattcttaaacttcggattcctcatcattctcatccttttcaacaaaataatacatggtaaagtatagcaccccccaccacatattaccagacggaaattttgggggcggcggggattcgacttgaagggccgccccccatctccgaatcccccgcggctaggtgcatcaaggcagaactgtacgctgccagggtgggaatgccggacgggggcagcggattgagctgaactggtgcatcgcaatgtacccagttagtttttatggcttatattatgctggcttctggggccaagaaagccacgccttgcccctccccgttccggcttcgtctcccgacgggatgcaccagcctgtgtggatcgggagtgagggcttctcaggggacacatccggtgatttcaggggcttagaatgcgcgttagaaaccgttgcatcaaatcggaagccccgcatgggcggaatttgctctccaaagcaaattccgagacgacctaagccgtgaaattcatcagaatttcacggtgaatgtcgtcggttccatgcggggcttccgatttgatgttacggtttcttcgcaaatggctgcccctgaaatcaccggatgtgtcccctgagaagccctcactcccgatccacgcaggcgtccccctttgatgttacggtttcttcgcaaatggctgcccctgaaatcaccggatgtgtccactgagaagccctcactcctgattcatgcaggcgtcccccccccctaaagtaacagtttttttagggactggatgtatttttctatgttttcttcctgcaggcagtagtatactttcccgtcttttttctgaacggtgacgaggccgctgcccattagaatgctcatatggtgtgaggtggtggacggagaaagatccagtgcttcggccagttccaaattgtatttgctggattctttcagggaacataagatgtccagcttacttttgtcagcgagggctttcgactggcggataacttcctcttttatgctgatcgatgccgactcgtttttctctaattcttcattcaatatgccctcgtaacagtaagaatacagtaccatctgaagcattggaaatacaagggttgggtaaactatgggattgtctccgcatgtgttgacaagcttcaggaatccgttattctcatatttggcaagacgttttagctgcttctccagtggctttgccacgcttgcacgggctctttcgaatgcgggcatattgaggcgtatagtctcaaacagctgtgaaaaccagtagtcgggccttcgcaggagatccagcacataccatttttcttcgcttttcaaatccgctttgtccaaaaattccagcatagacttttcatcgggcagctggggcatatcttttatctcaggcagctgggcatgttctaccgtatcagtaatgtaaaatgcgataaaactcctgagcttcataggatctaactgctcctctccctccaggtacttccggttctctactgtcattgtgagaaccatcataaataactcctgcgatgtgttctggaagaaaaaaccctcggaaggcgtctctactttatacttttgaaaagtttctatatatttttccactgtctttaaatgtttattataaaatgtttctccatctatcccataatcatccatcgcttttatgacatctgtcttccagtctccgccatgtgcaatggtaagaagccccagtatctcaaataccggatccagttcgttataaatctcgatactcataaaattcccccgttcttaatttcatgagtatagaatatcatacaaggagcgcaaagtgcaagctcagaagataatacccgcccgtaaattccctgctcagaacattttgtatacagattccagggcataatagctggcatcaaatatttttttcatcttgtggtagacttcctcattgtccgtatttggggtatattctttctgaattttaaggaaacggctgatctcttcgaaactgtggtaaacacctgcccccacgcccgccgttacggcggcggctatggaggttgcctcctccacatggtccggggtgcgaagctttgcctctaatacatccgaaagtatctggcacacgacatcccctttggctcctccgcccgtcaggatcagggaatcaacagataggtatttccggtaggcagccaggatcagttccagattatatgccacgccctcaattaccgcacggatataatcctctttcgtatggtgcatcttgatgccgagaaaagccccgctcgtctcttcattccagcggggacagcgctcacccagcatatacggaaggaaaagcagttcttttgccccggcaggggacttttcgatcatggcgttcagctcgctatatggtctccccggttctaaaagtccacgtatataggaatacgaactcccggccgcctgcatggctccgcagggcatatattttcctgggatgatattcgcaaagcagaagaaaatcttctcttcatccaggaatttttcttttgttgttccgccgatccaggccgatgtcccaaatgttgcaaaaagctcgttgtcatggatacagccggcgccaaccgcagcgcaggggccatcccctccgccgcagataacaggagtgccttcgcataatcccgatgccttggccgcctctttggtcacttttcctattatgtctgtggagttgtgcagttccgggagcagactgcgccggataccagaggcttccagaatctcatccgaccagcagagatgttccaggtccagcgcattggtgcctgaggcatccgaataatccgtggcaaattcgccagtcaggcggaatagaatataatctttcgcctgaagtgatctgcttgccttctgatatatctcgggttcatgttccttcaaccacataatcttttccagcgtataactgggattcaggcgatggcctgtcagttcgtacattctgtcaaatccaatctcgcggttcagatattccgtttcttttactgcgcgctggtcggcccatataatagacggacgcagtggctttcccttgccgtctaccaacagacagccctgcatctgcgcggaaaaggaaattgcgattacatccgttttttcgataccctccattacattttgggtcgcccggcagaccgcggcccaccagtcctcaggatcctgctctgcacagttcttaccaaaaaaatgcactttatagggaatggtacagctttttacgaagcggccgtcgatatggaataaagtcgctttattccccgatgttcccaggtcatgggcaatgatatattgagccatgtagatgcctcctttgtcttcttataattcgtaaatccttttatccccataggttgcttcccaatcggctgcaaaacctgcaattgcagaatcaatcatcggattttccaccatctgtgtgtaaagttccggagataccgtcaccgcctgggctcctgccataagcgcatccataacctgttgtgtgtttttgaagctggcggctacgatcttcgtctgaatctggttgtgttcaaacagccatgccatatcaccgattgcttttttactgtccacatttatattgttcatacggttaaaatatggcgccacatagtctgcgcctacggatgctgccagcatggcctgctgaggcatatagattgcagtcgctgtcacacggtttccgcgggatttcagcaccttcatcgtcttgattccttcctcattggcgggcaccttaatgtaagtgtcttttccaagcctgcctgtcaatgcttcggcctctttcagcatctcctcacatgtacttcctgtcacctgcacatggagctgcttctccccgatgatgctgcggatttccagaaggagcgggaaaaattccgctttctcctttgccagtatagtaggattggatgtaatccctgtgatgtcataaatgtcgttgtacctgcgaatgtcttccagatttgctgtgtccaatatgatttccataatatttatctcctttttaatagattcgtaacagttcagacaggtctgaactggtgcacaagatgcccttatggtatataaagttggtttatatagttgcctttatgatatgaatgccatgatcgacaagatcatccagtacatcatccggaagcccggaatctgtgatcagatactgcacctcatcgagagagcacagcgatacaatgccctgtctggcaaacttggcggattccgtaataattacaatctcttctgcattatcagccatattttttaatgtctccacacgcagatggttatccccggtaaaaccgcttcccggccggtatccgtccgtgcctgcaaagaacctcttcacatggaaagcctgggccgtcagctttgtgacaggtcctactacagactgggaatccgcctgataatcgcctccgagcagcacaagatgcacgtttgggcgttttcctatgtactctgccataaaggtggagttcgtaataatggtgacattctgctttgtccggctgagttcatctgccagaagaatgcagcaggagccggattcgatcatcaccgtgtctccgtctgccacgagcgatgcagctgcttttgcaagctgaagcttggtagaatggtttactgcaagccgccgcctcatatcgctgtcatcattcagaatggcatggccctgttctcttcgaagcagtccccgctcttccagctctgtcaagtcttttcgaaccgtcacaagagaaacctggcaatgctcagctattgccgtaacctcgcatcttcctttttcacttaatatttcgagtatctttgcctgtctttcctcaactttccccatatggattccccttttttctttcgaacgaaatatttttatattgcgtttgtaaacatattatattacgtttttgattatcagtcaacctcattttataaattcgatttatataatatttatttgacaatattagaattctattgtattctatattcatgaaatatattgcaatattgtcaaatttacatattataaaggagtctgtttatgagtttatttaaaaaaaaagaccgcgtccttttagcaggtgctgtcttaatcggcggaatcaatgccgcactcgcggctttcatttctatcttgctgcagcaaattatagatgtggctacacagaaagatctgagcggcttttccaatttgttcatcatcatgctgatttatctggcagcccttggtattatgggatttctggaagcatttcttggaaaactgctgcttcgcaatgtgtcccgtcatctgcgggatgacattttccgcggagttatcacaaaggagcccgttgcatatacctcccgcaacacggcagattatctttcggcactggtgaatgatgtaaagctggtggaggaaaattatctaactcccctcatgctttgttcccagatggtcgtcctgttcctgactacgcttggaatcttgttctatctaagtccggttatcacaggaatactgctggttttcctggttcttatgtttttgattcctgcgctgctcggaaagcagatgcagaaacgacaggatgcctactcggaaaaattggctgaattcacggcaaaagccaaagattacctaaacggatatgaggtcatccgtggatacagcatgcattcttttatatttaaaaaatatcgcaccgtcaataaggaaaccgcgaaaaagaagtttgctgcggatactcttctggcagtcaacgaatgtatttccgacattctatcttctctaagcgtgattgttatcgtattcgccgctgcatatctgctgctgaaaggacagattaccatgggtactctgctggccctcatccagttgagcagcatgtttgtaaccccggtcgtcatgctgatgcagaatattcccaaggtctccagtatgaaacccgttctgaagcaccttgcccaatatgcagaagcgggcaggcagctgccggactctgcgctcccaagcacgcccgcctccagacccgggtcttctcaaaatgcagagaggacagcagtccaaagtcctgctgttttccaggacgccctcgtctgccatgatgttacttttcactatcaggacggcccggacgtcttaaagaacttaaatctttgcattgaagccggaaagaagtatgcccttctgggtgagagcggctgcggcaagtcaacattaatcaagcttttgacgggatattccggatgtttccagggagaaatctgctatgacgggcggtccgtgacggattttacgcagtctgagctgaatcgtctggtctctgtaatccatcaaaatgtgttcctgtttgatgcggatatctacaccaatatctgcctgggagaaagttttttggaggaggaactggaagctgcactggagaacagcggggtcagccagtttctgccgggactcagccagggcatctactctcctgttggggaaaacggcagcctcctgtccggcggccagcgtcagcgtgtggctgtggccagggcactcatccgccataccccgatccttatcattgatgaggggacttccgcggtggatcagcagaccgcttacgagattgagagccggctgcttgagcagaaggaacttacggtcatcaccatcactcaccatatgaaccacgatttggaaaacagatacgatgatatcttccaccttaaagctgcagatatcaactttatttagaatacttttctttgtctgcgcctttaccgctgccggacacactgataaagggctgtacactaatcaagtgcacagccccgtattttacaatcttcctgctttcaagttactgccttttatatttttttcttactacaatcactattccggctcctgcacatgcaagtaaaattccccacaatgcgatcatattaccgctctcatctccagtctttactgtcttcgcgggtgtaccgccggaaggcttattcggattagagccaccctggtccggcttatctccaggctcttttcccggatctgtacccgccttcactaatctatcgaccgctttctgcagctctgcaacagcttggttcagctcatcgtctgtcttcactgttccaagcgcctcctctgccgctttaatcgcatcctgcagtgcattgtaactttcctccgtataaccgtcactcttaattgcccttgctttctcaatcaggtctgataatatggatgtatcaaattcgggctggtccggatctggtttgtccgggtctggcttgtctggatctggttcgtccggatctggttcgtccggatctggatctatgggctgcgcgtgcagattatacaattcttttacctgatccccatttaatactgtgttatatacagtgacctcatccagtatgcctttcagattcataacaggttctcctccagcattattccgcattgcaccaaaccatgtggtataaggtgtcagtgcatctgaaatgccttcctgggtctgttcggcaacggcttcaccgtttaaataaagtataacagtatcgccattttgtgacagagcaaactgctgccattttccggcttctactgcactctgcccgctctccagcagcatcgcggtttctccgtctgcttcgtgtcccgggtaggcgcctcttccgttattcatgctgaatttcaactgtccgtcttcgatatacagtttccacttccaactgtcataggaatcccgctctctgcccactatgacctgtataccatctgtattttcaacatttatccagccgttgagcgtatattcaccgttccctttcagaatatctcccagatccagataagaagtcactccatccagtgaaagtccctggccctcgataccttctgtccgtgcaaatgtcccctgtattgctccttctatgcttcctttactgttttgtgccgtattgccttcttcctcttcgaatttatattctccaagatatccgaatacaaccttcagaacattctcttcggtcatttcatttccaaccaaatctttcacatggtttacggatacattgatctctttcaacgcttccagcgttccttctatcgtcagaacgacggatttgccgtcttttccctgctccgcctttataacggatccgttttctactgtgtagttctgaatattttctgtggtttctttttctgtaaattcgttaaatgtaacttgaatctggttcttagaaactgcttccgctgaaacagcctgaggtgcggtatcatcggccattgtgcttacccggactgccgcgcccttacctgccacagaattatggactgccatgatactgtattcatactcctgttctgctgcaagcgtggtatccatatactcattcgtaaaggttttatccagatattccccgtttcggtagatatgatattccttgacattacgtccttccatctgcaccggatcccaggccagtgatgcatggtctgatgctgcttcctttaccgatgcattttccggcgccggaatttcaacggtcttagccgcgtcctccgggatattttcaggatcatatactgtcagccatgtataggtattcggctctaatgtcagttcgacttcgatatttccgttgctgtcgatggtatagttctttccattcatatcccctatgcatacataagcctcgttttctgtaggaacggcattcacttccggaatctctggtacccctggcatcttgaccagctctgcgtaaacaccgcttgcacggtaatgggaaccttccaccggcgccggaggggatgcaaggcctgtcaggccggtataatacagcgggatttttaccgtctgggtcacggtctccgttgtctggttgaagaaggccgccagccctttctgcacaccatcactgtccacatggatgataccgtctatcgcatctgttgtcaggcttgtatcgcttgtggcaagcggaggtgcgatgtgaacaacgctttccccaagaatatccttatacttattatagaattctccccaggtctcgattacattctgtgaaacttctccctgatacagtccgttccctccacggtaggaacctgtaattccatacatcatattcatgccgatcataaaatcataagccatgattttctcatcatacggccagaaggaagaatccgaaccgccctgatatggtgacagaggcaccagggtccatcccattgccggaactttctcgaatgtaccgtaatatgccatttccctgccgtaaatcagctgcctccatggcgttacattaaaccctggctcctgatagcccataaccgccatgctcgctccgaccgtaaagttccagtccggtgaattgatatatacatttctagcccttaattctctgtaaaaatcatgtactgcgtattcccactgctttgtctgggaatcttccacgccctcatgtccgctgtggtttgcagccgtacagattgcacccggatagattccgtcaacctccaggcagtccaggcctgtctggtcaatgaattccagcgtgttctccagggtttcatgtgcatccgttccgcacatgcagcgcatggttccccagcatccgctgaaactttcattaccgccgcgcgccgcctgcatcacatacgcgccaagcagcattcctttcttgtgggcataatcgcagagcgatttatattttgcaatattggatgcggaagtatcttctacattgaccccggagccaaaggaaagcaataccatattgaatcctgcattgtgcgcctggtcaattcccttcttgaccgttgcatcgtcagagctgataatatggtaaattaatggtgcatccgccgtctgcggaaacagcacacggtacattttctttacttccatcatctgccactcataataactattcgagtagaacatctgatacaccttataggaattaaaagtctcatcttttgcaaggcggtaatttggcccgatattcccggtatcatatcccatacctgaggcaatcgtattatcgcccgcgggagccgcataacggctgatgattttcccattcgtgccatctacatcttcccattgcttgtaacgctctttcccattattccggtcatggttttcattgccggagttcatggttccctctacatacagggcatctttcagactgacgggcacgggaagtatttccacttccattttatcaacgattacatcgttatttccttcgttggtcacatgtacggacttggagatggatggaatgccgtcgtagatctcatatctcacctggactttcacatctgcaaaatccttgtccgttccttttggcgctttgtagtttacaaccagcgctttgcctgccgctggccactgtgtatccttcatggattccggagagattctttcgtcccattcccagtggaatggctcttctgttttctcttcaatctcataatcaacaaactggaaggaagaaacatcctgattctcagcgccaatgtagaatagctggtcgccctccgtcgaattatccgcatattctttatttaatgtaatgctcgcatctgcctgcagatcctccgtattcagcagttccagtccagtgtacagattcttatagctaattgtctggaagtttttcccgatgtcaaataccctttccaccagcccgttagaaagaatcaatttcccttcttttttctctacggaagacgtaacatcgacatcaccggaagcccagtagtttaaatcactattttcagaatcaccagccaggtcagttgagacagaaaaggtccattctttttcctgattcacagttccctgtgcattcaccgcagcccctgccggtatatgataggtataattcataccgctctttagcttttcagtcggatagactgccagcgtctctgtgccttccacggattcattgtggtcttccgtcaatgcttccgtgggaaccggctttttatccttgtccagaatctgcggcttttcactgcccagcgcaatactcatattatattcgatgctgagttttccttctacgctcagcagactgccttctgcaggagagatactgactacttccggcggaatactgtctttgattccttccgtactttttttaatctgctctgcggtcagcgctttgtcataaatgcgtacatcatccattcttcctttgaatgcatgtccattaaacagacctgtgccgtctttgttgtatccgcagccaatcagcatagaaagcgggttggtgtccaggtccatttccgcaaatgtctcctgtgcaatcagatcgccgttataatacatgctgtaaactgttccgtcacaggtcagggcaagatgattccagttgttaaactcataggctcctgcccctgcttccatccatccgttgtttacatcatccctgatttctgcctcaatatttccgttattcctcacacaaaaataaaatgcatctctcggcaccgttgttttatccctgccgaatattttattcagggaattggcggatgaattatcaatattcgtccacgcctcgaacgtgtactgcgtatgtatctgcggccttccgatatcaacataggtcgtggccccgtcaaactcaatggatttatcatagataccaaaattatctacccggtaatttccatagatgggatattctttctgatcggcatgattgacgattaccttctgcccttccagctctccggttccgtctttgacctcatccatcgtaaattcataaagcgcgtccggtagtacaatgtcctctccgccgccaccgccattatcgatatcggccagcgtttgaatctcctcctcggataaagcacgggaatagagttttacatcatccattcccccctggaacaaatggtcaggaaatactgccgatgcatccgtattccagcaggaacctaataagaggtccaaatcccattcctccgtgggacccgcacatgtttcctcttttacaacggctccattcagatagagtctctgcactgcgccgtcattcgtgaccgctacgtgctgccactcatccatagttaccgttccgggatctgatgcggaccattccggacactgtgcttccaaagccccgttctgccgcatgtagagcgaaagttcattctccccggtaactgccgttctcccccttccgaagatccgcatcataccgctatgtgcagagtccggttttacccaggcggctatagtaagcgcattttctgtaacctggtagtctttccccaggtttacataatttgttttgccgtccatcagcagcgctttgccatgtccgtcttttccgtctgtcagtgcaggattatcccccaaaacggcataagccttgttatctgctttattcagtattgaatttccttccagtgaatccatatcaaaatcaatcagtaatccatcatttaccagcgccgccggttctaccgcctcttctgtccccagcggggcggccgccgagttaaacgacgagaacaacagtgcagccgaaagcagcgcgggcagcgtgcgttttattttctttgatttcaccttaatctccttttcctttctcataattcttattggtgcaagtgtttaacagcagccattttccttaacctctttccaaatagaccgcgccggcctcccaggagtcctgcggccagatctttagttccccctttccaagttctaatctgcattttctgccaaaagcatctgttattttccactttccttccggcagagttcccccgatactggtcggtggattcgaaaaagcatgatatattactaatacttttccatccatttcccggaatagaatctgagcgccctccaaatggtgctgattgttcctgccggtccgcacgagcctgcttcttcccttcttgatgatttttcttaccttcccgtagaaacgcatggcgtcctccacttcccgccattgttctgcgtttaaatcctgaacgggacccgacaggcagcaacgccccagcattccggaaatcaggcggtactggatttcctgcagaacaagttcgggagagatcaccgcccagacctggcactgcctgggcagcatcagctgatgaaggtttgccgctatatacgggatctcccggcactcatgcgcatcggaaaaagaactcatggcggtaagttttactaaggagggttccagccggtgtcctcccgatgcacagttttcaataaccagttccggatattccctgcggagtatacagaagaattggtgaaccgcctgcatctgctgccgcagcccttctcccaggctttccgcaccgtcgcacccgtatccgatggagccgttataatccacttttaaatattggatttcgttctctcttagaaaatccagcaccctttctttcagatactgcgtaacttccgtctgcctgaaatcccagaagcgcctgattcctcctgtctgtatcacctccccgttccggtataaatgcatagaatcatatgtgccgctgtgcacatttgccccttttgtcgtcacctcgaactccatccagatcccggttcgaagtcctgcgtccttaagacgctgtgaaagatacttaaggccatgcggaaatttatcctgatcaggttcccattccccgtttccgctctgaggatccccgtcttcacgctcttttttgctccacccggcatcaatcaccagatactttgccggcgtttcttttaatttttctgccaaagtaagtatttctttttcggtcggtttcccccaggttgtacaccattcattaaaaagaatcggaagttccttttcacactccggctgcagatccgcatatttatggaacatgtccgtgatattttggcacacatcccacagcccgcaggcgcttacgcttatatatgcctttggaggcagaaaacttgcgcccgcgggtatttctttccaccagccgccgaactcgcagtccgccacgcctccggataaggaatagcagtccccgtcccttgaaaattccatctgccaggatgaggccgcttccatctggaccgcccagaatacccccgcatcccggtcttccacgcatccgaacgggaaccagcgctttaccgtatgggaccccaggcagccatagcgctcactctccggaaaggccctaaaccaagtgccttccaggttcagctcttccactgtatccgcctggtgctttccctccaggctccagccgcctctgaatcggtgcagcctcagcttatagggtgcatcatctggttgaaaaggactcagattatccaaagaaaagctggtcatcatatctaatgtaaagggtctctccgaacgattttgaaactcattttccacttcaatgccgctttccccctcggtatatgtcaccgtatgcctgacgcagtacccctcttcggcctccaataaggtaataatacggatcacatttccttctttcgttttttcctggcttttataccgcagctttttcgtactctctccatatttcagtgtgcagcccgcaccgttgccctgggcatggtggcgcagggacaagtggcagagcgcccctatatcccatgcattacagatgttatcccgcattctcatataggtccttctcttttcaaagcaggaatccatcccctttggcagcagcaccatggaaatatggtctgtcaaatcatcccggatataacgcaaggttataccgcctaaaatataatcccactgtgtcataatcttttactccgcgtttttattttttgccgcgctaccccttaaccgcgccggccgttccgctgacaatgtacttctgtccgcagatgtagatgattaaaatcggcgcgattgtcaggataatgtctgcaaataccatattccagtcattgaaatgctcgccgaagaaattatagattgagtttgtcattcccagttttttattatcactgagcagatacagcggagtgacaaagtcattccatgcccccaggaaattcagaactatccccgttatggttgcgggcttcagcagcggaaagatcaccttgaaaaataattgaaatggggtacacccgtctataacggccgcttcatccagttcccgggggatattatcgaaaaatccatagtacaggaacaccaggaatggaattcccagggtcgcaaattccaggataatccccagatatgtattctgcagatgcagaaactttaatgtaaacaatgtggtaacataattcacgggtgcaatcagccccatgaagaagtacagatacaccctgttatgcgcctttgaacggcgccggctcaaggcataggccgccatggaagaaaccaggacagcgatcaccgtagacacacccgccatcagcatgctgttgccaaaggcccgcaccagggagcctgctttgattacctccaggtagttcccccactggaaaacttctggcagactgaaactcagcatcctggactcttccactgttttcagggaattcaccacgataaaatagatcggcacaagtatgatgcagctgctggcggcaataaacagaaacttcagtaattttcttaggtttttatatgttttgtttttattcatttttcccctttccgctcagcactctctggagccctaccgctatgatgactgtcatcaggaatatgacgacattcagcgcattcgccattccataacggcccatgccgaattctttgaatacctgtgtgttaataacctccgtcaggccgcccggtcctccgcctgtcagtgaatagatgatatcaaatacccgcaggccgtggattgtgttcaatacggtcactgtcatcagtgacggacgcagaaacggcagcgtgatctttgtaaactttttccatgccccggctccgtctatggatgcggcttcgtaatactcttccggtatcatctgcagcccggccaggagaatcatcatattccagcctgccatccgccacacctctaccatcatcgtggagcccatggcagtggcgctctctgtcagccaggaatgggtcagcccagacatccccagggcttccagaatgatgttcagcggtccgttgggcttgagaactgatacaaatgtaatacctataatcagcggagccagtgcatagggcagaaagaatatcgtccgaaacagattcctgctcttcaggcccttgttcagcaaaagagccaggcctaagcccaaaagcgttttcaaaataacggtaactaccgtaaactcaaacgtgtgtcctatacttgccagataattcccgccctttgatgtgaagatgtccacaaaattctgcagaccgataaactgtatatccggacgtgttacattccagtctgtcattgagattaccattcctgctatggtgggaataatatacaaaaccgtatataaaataaatgcaggcagtataaacctcatcccatataattttttcttatacatatttcgcctctaacttttttagtattttttgtaccaaaaaggagaatgaccgacaaaagccattctcccagccatacattgttctgcagctttgctgcagacccgcccgaagggcatgagttacggggtgccctttggtataacttattccctatttgccaaaactcggctgtctgaggtcatcaatccctttgagtacatcctctgcactggagttgcccaggaacatgccctgcattaagtttccaacctgtgcgttgtcccagtataaaacaccgtcttccgccgtaaaccctgtgcctgatgcattgtttataacgtcttcgtatgccgccggaacatttcccgggatatcggtgaaggaacatggtcccaagtcttttcgtgcttcataatatgcggtcaggttctccggctgtgataagaattcaaagtagtccataacagcgtccgccacttccgtatccttatttacacagcgtccaattccgcctgcggatacgccgaattctttgttgtcattcagcggaatcgggaacatgccccatgtatcctgtgtcatttccgggttcactgcctcgacctctgccgggaatgtggtgtatacaacgcccattgcatagtcgccggatgccatcttagctaccatgtcttcccaagtgtttgccataaagtctttgccgaagtagccggctttttcgagttcagccatctgatccagtgattttgccagtccttcttttcctgcaaagacctcactgttctcattcaggcctgcataaaacccttcgttctctgcctcttcctgtgttgtcattccacccagccaggttcccagatgccactgtgctgcgcccggctcataaatcggagtttttcctgctgccaggactttgtcgcatgctgctttaaagctctcatagtctttcggcacttctgtaatgccggcttctttaaaaatgtccttgttatacaggattccccagccatctacgctccatgtctggaactgtactattttaccgtcgttcgatacgccttcctttgcccagtcagtataacgggacacccattcctgatccgacatatccagcatgtatttctccggctggtatttgttaatcgttactccggaacgtatgtagaagatatccgcgccttcccctaccgataatttggagttcagtacattctcatactgatcgtccgggctgacctgccactcaatcgtattgcctgattcctcctcatactttgccgccagttccttatcaatgtcctttacccatcctgcggacgccgcgattgtgattgttgatccgccttttgatgtcgtggtgtcttctttcttgtccgatgtatcagaacccgaattcccacatcctgcagcaagcgtcatcatcattgccgcggtggccgccatagctgtcatttttactaactttttgtttctcatatccttcctcctttttcctgtaaaccttataatgctattatatcgtctatctgaaataaatctttagaaaaaatctacctgatgttgtgcacattttgtaccagctttccggctctattgatttttctcattctttcctctataatttttataagtaatagttgagtactctaattgtgaaacgaggtgcaataaatgaaatcgctacactctaaactgttttttagatacgctgcactgattttcccaattattgttatttttatggttattctttatattattttaggcaacacgctccaaaagaatgcaaccagcgagctccaggccgactgtgataatatctccacactcctggatacacagatgaagcagattgatgagctttccaaacgtattgtcagctctgacccgctccactcttatcttgtccgggatctatattcccatgatatcgattcctataataataagctggcattttccaccacgctttttgatattattaagctttctttcaaccatatgagcctcaacattgcagacatcgaaggacattatatctatgtaggcaataacagtatcttttcgatccgggatccgaaaagttatcgcgagatctcctggtttaacccaacgcttttagcttatggcaagaaaaagattcttccgcctcatctccccgagcttaacagctccgagaccccggtcgtatctctctgccgtgctttttccccggatgataccatgaatcagactgcggttttggaattgcagctggagtattcttatttagataaaaagataaagaacgcgcttcacaaccaaagggaaatcaaacatatttacgtttatgacagcggtgggacacgggtatatccttatgaggccagaccccctcagaacctggaaaaacgtatgctggagctcgcccggtcatcggagtccgactcccagaccacgatttaccaaacacgggataacgcttccacgctgttcgcctgtcatgcttccgacttcacaaactggaccgtatttgtcactgcagaagaatcgaagattttcgctccattctatcaattcaggacgcttttgattactgcctccttcctattattaatcctgctcctgtttatcacctggcagattgccaataagatgaccatcccgctgaagaagctggagcagacggcgcatgcccttacctttgacaacttaagctcttacgaactgccggattataaaagtacgttcagggaactggattctctgtaccactcctttgaacagatgcagcagaatctgcaggactcgctgcaggatgccatttccgcccataccatggctgccgatgccaagatgctggcactgcagtcacagatgaatccccattttctatacaatacgctggcctctatcagtattctggccgaagatggggaaaatgagcaggcggttaaaatgtgtgattcactgtctgtccttctgcgctatatgtcatccaactcttcaatggacgtggcgctctggcaggagctggaacatcttcgttcttatatatatttgatcaaggtaaaatatggtgaaagaatccagtttcatatcaatatggatgattccctttcaccaatcaaggttccacggctgctcattcagccgctggttgaaaactgtatcaaatacgcgctgaatgtggatcctccctgggttatacatataaccggatatattaaggactcctgctggatcatacaggttaaagacaacggttccggttttccgcccgattttctggattcttttcataagaaggttttggaaatcgactggaaaaagccgcttcccgagctttctataaatggcatgggaatcttgaatctttatatgaggctctttttgaaatacaagcaggatctcattttcagtttagacaaccttcccgaaaatggggcgtgtgttaccatcggcggtccgctgacacaaaacataggagataagcacgatgaaaaattatccgattaaagttttagtcgtagaggatgagaaccttctgctaaaaaatattcagaagaaaatatccgcagtatcccccgattttcagattattggggaggcttataatggaaaagaggcgctggagatcatacgtgataacccgcccgatatcgtttttacagacatcagaatgcccattatggacgggctggaactggcccggattctgtacgaagagtatcccgatatttcaacggtcatcgtcagtggttacgatgatttcgaatacgcccgcacagtgctgacctaccgcgtaaaagattatctcttaaagccgctgcagccggagcagctgaagagtattttattttcacttaaggatgctattgtggaaaaaaagaaggcagatatttgccgcacattgcggcaccagctgaacgccgaagaattcccccccgaattgcttaagctaagcaggacactcagtcagacctctttttccttatttttagtctgcctggataatctgtatctgcgcagccagaaacacaaacacttttctgaatccggcatctgttccggtatgccggattcactgacccgcttttcctgggatccgctggtcagcaatacggaatttgtatgctccggatactggatatttccctttgaaagcaggaatatattcttactggtaacggcggagttatcccggcctccagaatgtactgcaccgctgattttccaaaatatacagaattcccagtatacctccaccgtaaatcttgtctatgacaagaatgacgtaacattcccgcagctgcatcaatccctccagtcattaaaaaaccggatgctctcttcccttgtaattggaaagtcttccttaattgctttgccggcagaggatcctgtccttccccccgccattctttcaaaggtttctgtcagctacatacatactatgatttcatccaataacactgcgggttttaaaacagccctgctgcagttgtttgaagaatggaaggagaatccatatccccaggcctgggtggaaaaagtactgctgcagttattaaacatgttgcagcaagacttatatatctcggatgaagactatgaaaagatgtacctgtatgtctttgatattctggaaacacaaaatgatctgcttgcttccggtgaaatgattgcttcagaacttgcacactggatcgccttaacctcagccatccctactgatatagaggttacgatagaggaactggatgcatatatccgcctccattaccgggaaaatctgaatctaaccgatctggccgataaatatcattttaaccactcctatctgaccagaatatttaaaaagcaaaaggggcagtcccctttgaagttaatcaattcgctgaggatcgaggatgcaaaagagcttttattgaatcccgagctctccgttcgggaaattagcgaaatgctcgggttctctgatcagcattatttcagcaggagctttaagaactctactggtctgtccccgaacgaatacaggaatagagtagggaaataatggctagcattatttccctctcattgaaccgtacgtacgggtctcgtatacggctctacaacttatattccaacttatcttagataataatttaaaggattgagcaaaccagctccgtcctttatttttgtttcaagcaccattgggctaatgataaaattaactacgttcattccactctgtctgtaccatccaagtcttgagtttgcaactttatagattgattcatggtcgaatccacattcatattttctattcatatagcatagatttttatatatggtcttggacgttttccattgtttcatcacaattactcgaattttatgccttaaccattgtccgaaatcatccataaaacctttcatcattccgattctgaaatagttaatccaacctcttacaatctcattcactcgcttaattgttaccgcaagtggtcgggcaattgctttacttcttttgaggtattcacttaatttcttctttagcttctttttcttttccgtggttggttttactttccattcaccaccacttttcagaaatgtgaagccgagatacttacttcttgtcggtctgactacttttgtttttgtcacatttacttttaggaacagttttcttcctatccagtctgtaatggatttcattactctattggctgccatttcacttttcgtgaataccattgtgtcatcggcataccttgtaaaacgaagtcctctctgttctagttctttatctaacttatcaagatatacattagatagtacgaccgaaagtggaccgccttgcggcacaccgctccttgttgcttgctccagtcctttttccattacccccgctttcagatatttccgaatcaggttcaatgtggtactgtcgtttacttgttccctaagaatctgaatcaatttgtcatgatttactttatcaaagaattgctctatatcaatgtctattacccattcatatccctcgttcagatattccaatgcttgttttatggcatcgtgacaacttctttctggtctgaaaccatagctaaagtcactgaatatttcttcgtaaatttctataataggctgagcgatcgcttgttgtatcactctatctaagaccgttggaatccctagtggtctctgctttccattatcttttgggatataaaccctgcgcactggctttggcatgtatgttcggtttttgattgactgaatgatcctgtttttgttttccttgatatactcaccaagttcctcgactttcattccatctactccacctgcgcctttgtttgccactactttcttataggcactgtttagattttcccttgatgtaatcacctctattaattccattgttgttactcctctgattatcacaaaatttatgcacatcatccctctcgatataaacagtattcctcggcttacgttcctacttttcccatccatctgatttctgactaatgcatgattttcttaataacgatttgtactataaatcgtttcagtccttcggctttcacctactatgacatcatctgactccctccctaaacctttttcgtccacatctattgatgtgtgggtagggcctcccaagggtaaggcactaatctttcattccacaacctcttgatttacaacttcggttatacgtttacctttcgggctttggtttgatgtgcaaccttacccacctcatcgccttatcaagtttctgttcgtaggctcgtgaactttgctatgcgcttccttcatccacatcattactgatgccaacttgcgctccgctacacttggcggtaaatacccgtgactagactttcactagctagattagtgccatgcctggcacacacataaaataagcaccggaataacctgtattccagtgcttatttttaggatacttcttcgatctagtaagtccacccgtttttattcatttcttcaatggcatcggccacaagcccaacaaggatatccagcatctgattccctttttcgatgcttgccttggttggatctcccgtagccccggtctctgtaatctctttaatatcccagatgacacccgttgtctcgttgatctcgatcaccttctccggtacctggctcttcgcatgctccaggttcaccagttctggacgtacagccatcatgatggatgtctcaccctctccgccgtgtcccaggccgttccatacttcgaagcggtcgcccatgatcgggcctaccttggtccaccagtcaggcagatagaggaatttggcgtctttgtggcggttctttacgttatgcgccgcaatctcaagcgccggaatatttccgtcatgcccgttcaggatatagatatgtttgattccattgttgatcaaactctcgaatatgtcctctgcgattgcgatttctgtatcataacgaagggtgactgacattggatactggttgtaatggatggatgttccaaagggaacgcatggaactacaatgacattatccagcttttccgccactctttttgccacctctgtggggacaaaataatctggtcccagacagcagtgccagccgtggctctcacaggaaccaaaacaggtgattgctgttacctggtctgcatttttcaataattcctgcacctccagagcactgaattcatttaaaaatacctttttcattgtaaaacccctttcttttttgatctgctaattccatgataccttatttttttcagcttgctgaaaaaaccttccgcagggcatgcattacgggatgccctttgtgtataccttattttgcagcgatactacaaagtctccatcaatttctcgtcttccttcttatccggtgtaaaacgatagatgatatagtaaacaaacagggatacgatcattgcaaacagacctgccggcaggttgtacggcaatgttgtaacgtactggaagatatatcccagtgcagcgcccacgataaaggagacgatacctgcccagcgccatctcggctgtttatgaagcagtttatggtcatacttcttgtgtccgatcagatagtagtctgccagaatcggcgcgcaaagcggcggcgccattgccccaagtgtattgatgaaatttgcaaagaatatctggtaaaatccgatggcgcctaagatagttcccaggataccgcagatcgcaaccagtatttttctgttcgccttgatgccgacagcgtccagaatcggccccgtataaagggagttacagtacagctcgctgttatcagttgtccacagggacgtagtccacgcgaatacgccgataaatgcaaataccacgttcagccccatcatccatgctacatagttatactgtcctacgctaacacttccgatatagcctacaatgttaagcagcggattggtgaaaatgaaacaggatgcggcacacagccacacagccttaacgctcttgttaaaacggaacatatccacgcccataaccgcgccggcaatccagcttcctacaaccgccgtaataccagttccaagccccaggccgccgagctggtttgctttatccataaaacttccaaaaccgccgccctctctcatcattcctacgcctactacaatggcaactaccagaataatcgggcatgcaaatttggctactttttcgattgcgctgattccttttaccgcactgtatgtaaatacaattccccatacaactaccgcaatcaggacttccaatgttatatccggaactgcttcatatccccatgctgccggactgaatacaataatgccggatggattgccaatcaggccgccccagatatcagccaccatacctacaatactggagaaccagccgaatgtcataagagccatcatcgccattggaatgataaatcctttgcttccatatgagtacctggaaatcaaagccagattgagtcccgtcctctgtgccgctaccccgagcagggaggtcataacaaacagggctcccatccccagtataatcgccaggattgcttctcctggattcagtcccggcgtaccgccatatcccgccagcgtaccaccgacgaacaggcctgttgccacatagccgaagcctacccataccatgacctggctgtaggtagaacggcgctttttcataggaacggcttccagcataaattcttcgtcaactgtttcctccggtactatgtttttttcttgttcctgcatataaacctccttagtctaaccctcattcccgggctaatttccatatcccagcgtaacctcgccggcataatccgtattaaatatttccctcactttgctgctgtcttctgtctggcccaaggcccacatcagttttgtaacaattgcctctgtcgtcatatctcttccctgtatcaccccacaatccaaaagcttcctgcccacttcataaagagaaaaatcactcttttcatataaacactggctccttgcaactacagaaatcccgctgtggataagtttctccagtttagggaccaggtttcttctctcaaagtgagtacctccggcaccgaatgcctctataataatcccccggtatttcatttccagcagcctgtcaaatatatccgggttcgttcccggtatcagcttcagcaaaaacacatcggggcagagattttctttcaggcagaaatcccttccctctctgccgctgatatccagtttgtcgtacagatgtacgccgtctgcatacacctcgcccaggtagggcgccgagatgctttcgaatgcattaaatcccagggtgcggaccttcacgcccctgcatccattgatgatcttgtcgtcaaatgctatcataacccttgggatccccgcgtccaccgcggcaaatgccgtctgcaggttccgcttagcatctgtaaacatctgctcaatcggaatctgtgcaccggtgaataccaccggtttattcaggttctggagcatatagctcaatgcggaagccgtataagccattgtatcggttccatgtgtaataatgactccgtcaaaatccggaagcctttccgccacaattcttgcaatgtactgccattcttccggctgaatattggaactgtccagattcagtatatctttgctttctatcagaaaatgctgttttaattcgggaagcatatccagaatatccccgcatttaatatccggggtaagcccctgctttccctgtctggccgcgatcgtgcctcccgtggtcaataacaataccttcttcataacctaattacacctttcctgatattcacgggcacctgttctacgcaatcgccagtgcctgctgcagcatagaagcatctatattgccgccagtaatgataaaacatatttttctgcccggcctggtatcaattctgccagtcattgccgccgctatcccaacacatgccgaaggctccgcagtaatcttgcccaaaagagctgcttctttcatcgcgcgtgagatatgatcctcatctatggttagaaggtggtccacatgatcccggatcagctggtaattaatctcttccgccttgcttacccgcaggccgtctgcaatggtcgctcccatctctaccgtaaccggatgtcccgcacggaggctttctgtaaatctgggaacctgctccggttccaccgctgtcacacagactcccgagtccatctgcttcattgcaaatgctgcgccggccgtcaggcttcctgctccgcacggcactacaatctcatcaaaaccgccgcactgttcccatgcctcaacagccgctgtcccatgtccggcaatgacatagggatccatgtgggaatgcaccaggcagtatccgtaatcccggatcagctcctcacacttccggtcccggtcttctccggtaaatccgcagagcaccacctcagccccatacccttttgcccccgcgacctttgtccttggagcattttccggcatcacaatcaccgctttggttcccagcattctggccatatagcttacagcctgcgcgtggttcccgctggacgcagctgtaaccccttgttttctctcctcttccgtcatgctgagcatcttgttggcaacgccccgcactttaaaagatcccgtatgctgcaggttttccagcttcagccaaacttctgcacctccaaaaagtttctcaagtccttccgcccggatcagcggcgttactcttgcataatcctgtatccgtcttttagccatcatgacatctgcaatctgcagatttcctgcggaatccataataatacctcctctcgtcttcctctatactacagccggctttaaagtccagcattgcagtttcgtctgctcaacaatatgcggagcatcaaagtcttccgcccatacgatccagttgcccccaaactgatatgactcatccacatggtcggctgccgccaatcgtcccgtctgcacctccacggtatccgtgccttcccgaagcgctttcgccaatgtgcagaagagatctgccggattcagaaaatgatcgcccacccggtacaatgatttcaactggggatatcccatcacgtagtcccgttcagttaagactgcctccgcaagttcctgcgcgctgacggttgctgcgtgaacaatagaccgttcttccttctccggtccgtacagaagttccggaacaagcattctgcctgtcactgcctttgcaagcaaagtcagcagttctgacggtgcaagcatgccgccctttagggactgatacgtaattccgccgtcaaatccctctgcatattccttcagatctgatacctgcaagggaaccagcctctgcttttcatagcgcatggcctctgtggccgttatgtattctacgttctccttcgcccccgtatatttcagaaatccccggagcgcctccagattatcttcatatgccttccggctgcggagcggtgacggccggcaggttacggggtttacccctccggcaaaattcacttcatcccagaactcttccgctactaactctgtcgggtgatcataaatacttagaaatacaacgtcctccccacgcatatccatttcatcaaaagcctggatcatgtgatccagctgatttggctcatgcctggaatggatcagattcacaagcccggtcatacagtacaggcccgcataccagaatatcccgccattcacgtccatgatcggatgtgcgtccatataagtaggtactcccatcctcctggctgccgcaaatgcctgcggcgcccatgccacgcccggatgtccgtagctcatcaaatgctgtccggtaagctccgccagcttcaaaaagcccggatattcccgccggaagaattcttccgtcccctcccggaacccgtaatgttccaggtattccgtgggcagcgggtgtatactgtgctccgttgtatggaagcaaagctcatgccgctttaacttctcaagaatatcggtgcgcccctttttctgtaaaagttccaccttttttgtacagaacttcagtgtcgcacgcactccatactcatccaggatccggaggatatcataaaatgcatcgtccgattccgccgtcagatagtcttcaacatcaaaccacagcaatactttgatctgtttcatcttcatcacctcttttgcctattcttagtaacctcttgtgtcccgaaagtaaatacggtattccgcaccttccagctctcttgccacatactgctttgcctgctccacatcccgcttgatcagcacctccaccagctccatgtgtgcctccagaagcgccttggcgccagagctcttccattctcggacaaagacccttcggaggttgttgagcacattctccaatgcagacaccagatacctgttgcgggacaaatatgccacggacatgtgaaaatccatattcatctcgctgtattcctgatatgtactgccctctgccttcttcacatgctcctcggtcagttcctgtaaaaacctgagttcatcggctgttgcatactggatcgccatttccgcacaggccttttccaagatgcctctgtactgaaacaggctctgcagctccatgacggaaatccctttaaccaggtatcccttgttcgggatcttctccagaaatccttccatacacaggtaattcaacgcttccctggacggtgtcttgctcactccaaatttctgggagatctcggcctcggtaatcatatcgttctcattgtagttccagttgataatatcattccgaagttcattcagcaccctttctgtcatagactgtttctttgccatcttaaacctccctcccctgtcatattctaacgatgtatcagtgatatatcactgatgtattttagttaatattaacaagccgcctcttttttgtcaatacttattgtgaactttgtatagggtccaagatgtttttgtgttacagttcagacaggtctgcgcatttactgcgcagaccatacgaaaactttgtggctgcaggcattcagcccttcgccgcaggcgaatttcaatgggctggatgcgtaacagttcagacctgtctgaactgttacgtttttgtaactatgcacgtcccataggcagtgcatagttacatgttttccacaatatggatattaaaagtaatcaatgacatctcttctgttagcgtgtataatagataaaagtatatatcttccatttagactattggtacagctgatagcggataaggagtaatcatgaaccctcatactctatctacgcattttcataattcatttctggccagggctatcaggaacgggttgacacttgccatcccgtttctgattatgggctccttttcgctgctgttcagaaattttccgaacgacagctatcagtattttctggagacctggcaggacgggggcgcggcaacgcttctggatacagtttacaccgttactctgggatcccttgccatggtgctgtgcatcacgatcagcctgtcttacggacttttggcggaaccggaccgctttatcctttatcccatcatatccatctgctcttatctggctttctgtggaggaattcaaaaccacgacgattacatattcagcgcagaatgggtgtttacggctatgtgtattaccctgctatcctgtgtgctgttccgaaagatcctggaactgggcagccggctggagcggcttcacacaacaggcgccgaatatctgttcaacctgtcgatccagagccttgtccctgctatattaattgttttagtctttaccgtggttggatatctgctgcgttctgcctggggcagcagtaatattacaaactttggctcctatatattcctgcagatctttcaggggatcagtggtaatatatttggcatccttctatatgttattatcactcatacactttggtttttcggtatccacggcacaaacacactggaagcggtgtcccagacattatttgaagataaaatagcaatcaatcaaactctgctgaccgcgggaatggcgccgacagagatcttttccaagacgtttctggacacctttgtattcctgggcggctgcggctgtgccctgagctttgttctggcgctgtgcattgcatcgcgtaaaagccatcacaggaagattgcacatgtggcgctgccctccgttttgtttaacatcagcgaaatcgcagtatttgggtttcctatcatctttaactttacgatggcagttcctttcctcctgacaccggtcgtactgacgcttaccagcaccctggctacctggtttggcctggtccccgttgtaacacagtccgtagaatggaccatcccccttttcctaagtggctatgaggccaccggttccatcgcgggaagtatactgcagctttttaatgtagccctcggcatcctgatctatatcccttttatccggcgtagtgaaaaaagggagacccaggattttcaacaggcggtccgccgcatgagtgaagatatgacagccggcgaaaagagcggcagcatcccgctgttcctgagccacgactattccgacaactattacgctaagacgcttgccatggatttgagcaatgctctgcgccgtagccagatcgatctgttctaccagcctcagctgaccgcagaggaaaaggtccatggagtcgaagccctgctccgctggaaacatccggtagcaggatatatcgccccgccggtcatcatcggcctggcatacgagagcggcattctaaatgaactgagctattatctcctgaaccgggcatgcaaagacgccctggagatccagaaatatacagaagaagagattttcctatcctacaatatttcgtcaaagcagatggaagaagagaatttttttgaaaaggtaaacgaaatcatacagagctatcatttaaaaaccgtccacctggtactggaagtaactgaacgtgcagcgatgcgcgtatccgaaacgctcagccaggatgtcaaaatcctccaaaattacggaatccagttcagtctggacgatttcggcatgggccacaactccatcctctacctgcaggaaggaatattcagcgaagtaaaactggacggccagctcgtgtcccaaatccagaacaacgagcgctccaaagaaatcatctccggcatcatccaaatggccggaggactcggcctccggatcgtagccgaattcgtagaaaccaaagaacaaagggacctcctcctaaccctgggctgcgaactctaccagggctactactacagcagaccactagaactttcagggctgaaagaatatatagaggagggaacacgccattaaccagctaaaagaaaaagaagaccacccgtgcccatgggcattcttccgcttttcagctcccagcttttttgaagtagtgccccggatgtgcatgacgcaatctggtaaaagaggtataggggtgtcttacgccgcatccaggcacccctataccccttttatcagattgcgtcaaacaccccccgggcacgatttcaagaaagcggacacaatcaccatcatgggcctccgcatctcctctttcatccctggcatccccatcatttcctccggcggttgtggttcgataatatttctcagttcaaatccatttaccagaagtgtattcaaatacgtagtcagcgtcctgtggtattttatcacccgctcccccaggaataccgcttctctttccccctcgtaataataattatcaacagggaaatgcaggatattcccctcggcatcgtaataccagtcctgtgaaccagaggctgtaaaaaccggatgctccgcggaaaatacaaagttccctcccggtaccatccagcggctgatcttacgcacgatcccctggaaatccttcacatagtgaaatgccagggagcttaatacaatatcaaatgtattgtccggaaattccaggtcttccattgcacacacacggtattctatgctctcatggccgtttttttcctccgctgccgccagcattctttctgagatgtcgatgcccagtacggactctgccccattttgagcggcatagatgcagtgccagccatatccgcagcccagatccagtaccctctttccgtggaaatccggcagtactttttgcagctcagaccattcgcctgcgcccgtcagtccattctttgaacggctcatttcgctgtatttctcaaaaaatatcttatcatcatatttattttctttcattttatattcctcccatgcaaaatgttattattttcctgcttctgcatgggctgctgcaatcttctgtgcaataattcctccgcacatatgctttctcctcctgtgcattttcttctttaatgattcctgggaatcttatctgattccgccctgccatttttctgctgccaggccagacaattggcgagtgcattctttagatgttctatggaaataggcttcgcgatatgaccgctcatccctgccatctgtgcctgctttacatcttcggcatatgcattggccgtcattgcaatgatcggcagttcatcaatgcattcttttccggaactccgtattctgcgtaccgcatcgtagccattcattaccggcatctgaatatccataaaaaccaagtcaaagtagaaggggggctttgtaagcacggcgtctacagcctgctgtccatccccggccgtctccacctgcacgcccagaactgccagcatctccgccgcaatctgcatattaagctcattatcttccaccagcaaaacccgcagacctgcaaataattcttcggattggggctgctcttcctgtaaggcggttaccggaacaacgcatttactcagacatagggaaatgacaaagcgggagcccttcccatactcgctctccacctggatatcaccgttcatcatatcgaccaggctcttcacaatagtcataccaagtccggttccgggaaccttactggtccggctgtcatcggccctgctgaatggttcaaaaatatgctgaagatactcgggtgtcattcctacaccagcatcttctattgtaaaacgataggtacctgcctgctgctcttgtttttttagctcttccagggaaaaagttatcttcttccctctattggtatatttagaggcattctcaagaatgttgaccaacacctgctttattcttcttgcatcaccgatcacctgtgaatgcagctctggatcgatccaaagttcaaactcctgctgtctgcgctccagtggaaggcggatcatctccgccgcctcctccatcagagaccgcagatcaaacggatgttcttccaactgagccgcaccgctttcaatcttgcttacgtccagaacctcattaatcagactaagcagatgctgccccgaggtgtctatcttttccagataatcctgcagtttttcttcctccccgggatgaagccgtgctagttcagttataccaagaatcgcattcatcggagtgcgtatatcatggctcatcctggagaggaaatcgctcttggcctgactggccttttccaccttctcaagtgcatcttccagcagctgtttggccctccgttccttttccagcatctctctctgcacacggcgttcctcgtcaatatttctggagagagtgatttcgatcaaatcatctgtataagggctctccactctcactacctgagtaaagaaccagtggtactcaccatcctccccaagatggggcacctccatcgtcacaatccgttccccatgtgaataaacttcgatcagagactgccttgaaaatttcccgaaaaactcctcccgatagtccggatgaaccgtggagagctcccgctcaatcagatcgttaaaacagccggcctctcccggtttttgaaccatatttctatcatactccagcatgtggtaagtattctgcgtcaggttgaccgatatcagcatctgataggcgatctgggcagcggtcgccagctggctgttttccagctctctttgctgctccagcaggtattcgtcttgcacgtcacggaagaccaggacgcaccagcactcttcttctccaattttatggatcttagcagcggtaaattccaccatatgatagatccccccactaaccttcctgcgaagccgctttgatatctgcttttttccctgcccgaaacgccttagcatagcatctctggaaaaatgatcattgaaagtctgcaaatcatccggatgcatcacggctttggcgtatctgtagttttccttaccaaagcttccctgttccgggatactggtccacatcatatctttctggcagttgacataatagtcagccgtcaggttggcaatgatacattcgtcgaagactgttacaaggctctgagcatacatccgttcaattttctccagcccctgctcctcctcgaagttcaaacggtgcggcgcagccgttactactactgcgttgatacctccatcccaaaggatccggcttgcagttgcatccactgtagttttaagcagaggatcataacagacaatatggttcgtcccactgtctcccagaccatcgagcggacaattcgcacacacttcaggccatacgtcatgacatcttgcccccaatgcagctttgccccgcccagtatcccggcaccgctgattaaaatataacaatttatgtgtctcttcttctattacatagatacttgtctcagtcagtgaatccaatagattaacgagattatccgcaagcatggttcccctccttatctttgctattacaatctcagcccctgacagcaaatcaattttgctcccgtccggcatacctttgcagtaccccgagaagcctgctgaaatcaatcggcttcgggatatgatcgtccatcccggctgtctgtgcctttgcgatatcctctgcaaatgcattggctgtcagtgctatgatcgggatccccgccgcctgaggatggcggctcttcctgatctctctggccgccgtatatccatccataaccggcatctgcagatccatgaggatcgcctggtaggtacccggctccgaacgcacgaacatttggagggccttctctccattttctgcgcagtctactgccataccggattcttccagtattgttttggcaatctccatgttcagttcattatcctccaccagcatgatccgttgtccccacagcgtaccgggcggaacctgatcctctgtcttagagccccaggcggcttcctcccggtcagctttccgtgcgttcttttccgatcccgctgtcttcagcgtaagtgtaacaacaaagcggcttccctttcctttttggctctctacctggatatttccccgcatcgcatttataatttccttcgcaatcggcatcccgagcccggttccctgtatgttacgtgccctcacatcgtcttcacggttaaagggaataaagatgcgttccacgaaatccggggacattccaatgccattatcttccaccgtaaagacaaagctaccggctcccggagttcctgaagatacctcccgcagcgtgatatgtattttcccgtgctctggggtatatttcaccgaattgctgattaggttcatcagaacctggctgagcctccccgcatccccgatcagattatcgtgaaccaaatccgatatctcaagccgcacctcctggttctttgcctgcgcttccccacgcataatagatacaagctcactcagcatactgctgagaataaaaggggcctcctccagctccagactccccttctcgatctttgccatatccagaatcttattgatcagctccagcagatgtctgcttgcggaacctatcttgtccaggcagtcttttaccttatccggatgctccagctgtccatacgctatagatgtcattcccatgatcgcattcatcggggtcctgatgtcatgtgacatctgtgccagaaagctgctctttgcctcattcgcattctttgccttttcatatgccgccataagtgcctgccggttcagctcctcttccctgatctcctgaagcttctgctcatgaatgcccatatttgcaaacacgaccttcgttacttctccgtcccggatctccgcaatactaaaacgggagcgcacccattttgttccatccggatagattctgcggaaatctatgtcatagaccggatgttcttccgacagagtcttctgaagaaacgctttgtctccggccctcttcatcttctcccggtcttccggacagacatagttctgcacaaatttatcatagtagaaatccattctgccttttgggaactctttcttccggatgatatcctcctgccagattgcttcctctgtgttctgttccagatcaaagagataaatagaatagtagcagctgcagagattagccagcacagcctcccttcgctgctgttcctgtctgtcatccacatttctcaccgtcatcaaaatacgctcctcaaagtctctgcgtatacaggccgaataataagcataataatgcaggactccctggggatcaaacatacgaaacgtcccttccagagttccatatttgcgatagttttctatacggaaaatatggttcagctcccgccggtcttcggatggcattttctgcgctatctgcccgtataattctgtaaaactcccctgctttgaaagctgcagctgctctcccgaatagtgaacacaatgatactccgttttctttaagtccacactgacaaccaagcggtacatccgggacactgcctcctgggataccgcctcattcagccgtttttccacttctccggcctgatcctccagagtcacaagtacccagggatattccgcagtatatcctttgagcagcagtacccggaccctgcaccatttcccttctttgttctggtaaaatgcctcgggtcctgctccgtcctccgacaattttccatgaatggaatcggcggcaacggcattcataaagagctcccggctctgctgcgccacctcctcctcggcatagcggcggaaaaaaccttcataatctgggaggacatcggaatggatatccagctgattcatgtgtacggatttataagttttatctatgatgttacacagatagattcccctgtagttttcattgagcgtgcggatcactgtatcatactcctgcttcagcatcaccgtattcgtaatgttctgatggtatcctatgaggcagacgccgtccttataactccagtccctgacccctccgcagcgcacatagacctgcccccacacgggatgaagccacgggtactgtacctccgccctctcgttggcgctaatccgctccactgcgtcgtaaaccatggggtaatatccggagtcaatccgaccgaaccatacatcataacactcctctggtgacggttcccgttcaaaccccaaaagctccagcatggctctgtcggcatacatcctgggcggctttccctcgtccagctcaattgcccacaaaccggtctgggccccttgcagaagctcctgaactttttctatatttttaaaatgatccgacatcgtataactcctctctcctcgttgtcaggggccttgtcttcctttgttttctgaaataaatacagcgttttctatcattataacacggatttaaagatttccaaatcctcatgtataaaatttgactggcgaaatagattattttttaattatttgtccttttgctctaccagttcaccattttcaaaaactacgattttgtcttcaaattcaattgtccatttacagggatcttctttcgtgccaatttcatcttcccaaccgcttatgtctttttctgtaccaccgattttccgaattgataagacttttaaatatgactcattttctttcgttgtccccgtaaaatatatttcgtaacctggtttcgtttccagctctatatatgctatgttccccctggttccatagtttaattttacctcatcaaattttacgtggctgtaaaatctcggcagcagcagagctgtaagcattgctaaaaccaaaaccgcaccacataccacccccagtatcctttttcgtctctgcctttttattttttttatcagttctacatcttggatctcttcctcgcttataggcacggcttcgctgatttcccctgtcatttcccgatagtattctctgcactctctgcaggttttcagatgtttatcaatctccttattactctcttcgcttgtcagaccgtcaatatataacggtaataaatcccgaatcatttcacatttcataataaagctcctttcttatcctctgcttgccacggtaaaatgtaactctggcccagttttcatccctgcccaggatctctccgatctctttaaaagaaaagtttccgtttaaccgcagatacatcacttccctcaatggctcttccaatgtatgcagtcttttatacagttccaaaacttctgctttttgaatggccgcggtttccggtccgtgatctaaagacgcagtttcttccgttatttctgccggcttctcccgttctttctttttcagctccttataccagagatgtttggcgatctggcacagccacacatacagcttacagtctccccggaaatcatcaatggttttcatggcctgatagaaggtttcctgtgtcagttcttcggtcaaatgcgcattatgacagagactgaacagaaatttatatacctgcggcatatacttcttataaatctgctccatatcattcatgttccacctccttgcctataagtgcctgtgaaatgattttcgttacagcttttttcagtatttttgtaaaaaggctgttgcggcaaaaagcggcaacagccttgcggatataacttaattatttatacataaacaatcctgacatctgctatatcagactctttttttatatctgacacaaatccagccggaaattgccgtggcaatcaggaaaacaattaacggtaatgtaatccccggaagaatattccataaataatcattcacctgggatatattatgaagtaatatcaccgccgcgattgctgtcagatagacaccggcacagctaaatatgcagatctgtgaatcccttctcttcttactttccagctccagctcctgctgcttcttctccagtatctcagtctttatcgatagctcatccaattcagagggtttcagcagatagtctgttgtaacttgaaaaacctcactgagagctatcagtttttccaactccggaatcgtctgtcctgattcccatttagagacagattgtctcgatacatttagtttttctgcgagctcctcctgcgtcagattatttgcttttcttaactgtaaaactttttctgatatttccatgtttgtttccttcctttcttttttctgcctcaactatacccgatccgtcagttgcattccagcgactgcgctgtatatctgcgcaaccgatacgggcatcggactggcaattgaaagaaagcctctaatattcaggaaatctttcttttcccttttttccgcgtactttaggtgcggtcaaatcataactctcgcaaatcatcctctgtatctcttcttccggtactgttccgtccaatatgattgaattccaatgttctttgtttagatgataggccggctctaccgaaacaaatgcctgtcgccagaagtccctccactcaggactacattttacatttatccacacatatccgtttctgttaaatatccatgcaaataccttcttattactgcgatgcctgatcacacaccagttctggtcatgaaaaggatagtcttcaaaaacattgggcagggtcaggcagaaggcgatggcttcttttttctctgtcatataatttcctctaagcatcctttctgcaccaacatccgatccactggtgcaagtttatacctttgtagttgctctttttctacccaaataatttcactgtgtacagtaagcctgaagctttcatctattggaatggcactatataatgccatcacatattcattatctttcagagaaaaccgctcttctcccaaatatgcttcaacccttatgcttaccgcaaattcttctgcaatttctcttgttaggcattctttatctgattcattatcttctacttttcctcctgggaattcccaatatcctgccagggatccgtatttacgcttcgctattaaaatcttattttcttttacgatggctgctgctataattctacgcatattcatcccctcatgcttattacaaacgaataactttattttactcttctttaacacttagtcgtttacttttaccacggacgttttttccccgtccatcctttttcatgccaataatttgaatctgtttcattccaaccatttttttgtaccaatcgcatgacactaaaaaatgcctttgtttttatagatggttttacactaccataattttttctaattctttttgccaaagatgtggtttttttctctattttgttttttattttatcattcactctattccatgaaacttccctcacgcctaccccatatttataggtttttgcaacaccccaatagaaggtactgtctgccatatccttattggtgctcttcatacctccgcctgcggctgttgaaatgcagacggcctgcttgctgaacatgctttcttccggacggtgcaccagccatctataaccataatgatctaaaaatactttcattgcacctgttacatgatatacatataccgggcttgccagaatgattacatctgcgttatctatggcttccgtaataggtttcagtttttcgtaatgtgggcataatgtttcagatttcgcaaaacagtttgtgcaacctatacataaggagctaaactctctcggcaggaagaattctgcaatctctcccttcagcttttccgcaagcattttagcaatatgataagtcgaacctctatggctctgtccgtgtataatcgttattttcaccttttaatcctccattctagtatggcaatgccacagccgcataaactcgttttccctggggattagtattctaaaggccttgaaataagaatccggcagatcaggagttcaaaactttagttgcagttcagatacatatctcgcggcaacaacgactctcttgtatgttattataactctataatgcgaaaaaggaaagaaatccaatcatagtatgatatggttatggcaatactgttactgttcacaccctatgggcgtgcacagtaacagcatctgcccatttaaagtcgcctacggcgaggggcagatgccccgagaccatcacttcatcggctccgataccgtgcagcgaagtgcacggcacggtctgaacagtaacgcaatactcagtaacaggtcagacaggtctgcgcatttactgcgcagaccatacgaaaacatggtgggggcagacatcctgtctccgctctgcttcggtccgtgctaaacgtgcgccgctggcgcacagccctcctcgccgcagacgaatttctatgggctggatgcgtaacagttcatggctgtctgaactgttacaatactcatgaataattggaggttctgattcatgaatatggaagaattgagagaaggcgtattgggatgcagggagtgccgtgaattgtttggttacgaaccgcatccaatctttaacggctgtgtggattcgaagattatgcagattagccaggctccatcgctgcttgtgcatgaaaccggcaagccctttaatgatctgagtggaagacgtttgcgggagaaatggtaccaaatagaagatgacgtgttttatgatccaaagaatttttatattacttcaacagcccattgctatccgggtaagaatccgggaggaggtgatcgaagaccaccgcagggctgtgccaggaagtggctgcagcaggaattgacattagttgataatcagatctatatattaattggaaaatatgcagcagattattttttcccgaagggtaattttacggaaaatatatttcgggatcatcagattaatggaaaaccagcatatattctgccacatccttcaccgctgaatgttaaatggtttaaagatcatccggaatttgaacgtgaaagaatgccggagattagagcggttgttcatcgggtgttggagatagaatgatttaaacagggagggctttatggaaacttacgggttcgtctgttttccctaagtcctccctttaaatataaatctaaggcgtttgcgtgaatcgtcttgaccgttgactatctaggatgggaatgctatctctttttgttgtattcatcaaatataatcagaaatatacggtgtttcatgcagtaagacatcatcaagtaaatgtatggtctgttcatctgctttcattctgcccattcggtgcagcttcgctgccgttttatatcctaacagcattgtagtcaatgtagcgatggtgagttttactcgatggtgcgtctgtgcctttgtcagtgagcattctcccttgtgaaagcgaacggaaatcgttttgttgttccatgacaggaatttatcctcaacttcaaaagaaatacaaatattatccgcagaggaatcacaatgatatttctggaagaactgttcaatatccacgatacgtcccatgatgtaaggacgaatggtttcccggatatcaccgtcctctaactcaaacgcgattggatcattgtaataggaactcccccgcacttcatcaatcattgaatcgtgtgcccgtatgtattcccataatccctcatgcgcttctctggttaaataaatcatctctttgatgtgcatcatatcatctttgataagatacaccatgtaaccgcaggatttcccgtttacatcgtaatagactgcaaccacagtatcatcttcatcccaacgccagtattcctcccacgcaagtgcatttcggaataggcatccatgtgttgcggctgcaaactgcgcatgcagattgcgaaagtcctcattctcccagtcaactcggcgtacatatcccggtgcagacgctttggtaggaatttgacggtctttcacggagtaagtaattttattggaaataatctcccatcccatttttcggtacagtggaatcgaatacgggaacagcaaagccaggggctgtttcttctgacgcatatgttcgagactctgcagcatcagacgcttcataatgccctttccggtatattccggataggtacatacactggtaacaaatccaaccggataaacagcgctgtaaatattcattttcagcgggtatacggcaatctgcgaaaccagcgtatcgtgatcaaaacaccccaatacatcggcgcgctccaaaattggaaacttagactgcttgatttcatcgccgcaccatccataaatcgaaaggtcttgttccgtgatttgaaaggcatagcgcaaaagtgagttatactgttctagatcatttgtttttaggtaacgtatatcatattctgtgttaggtaacatatttttctccattttcttgattagatattcatattgtaagttgtattaggaaatatagtcacttatgttttgtcatgcagcaaaagccgttctaattcatcggtaaagtatgtaagcgcctggacaaattcatctccactgagctgcttatgggacaagagcataatactttccacgattctaaactctgggatcatatctacataaaataccatattttttccagcagctaatcaaattcacttctataatctttgtcttgaattgtcctatctgacccatacaactcaaggtctatatgcggtttatttaactcaataagtgataacatatactctcacctccagctcattactgaagcattccaactactttgccattcttcttcattcactatcgcctcaaatacaggttcaaggaaagtctggatttctgcaattacaacaaaaaactcaagcatatcatcttttattgttttcaaaaaaaatttccaacgctttttcatatcctcatcgccggcaagtgcaacaatccgtttaaaactatctttatcgtatgaagtaccacgccgctgcaaagtttcaaaaagagcagcttgcaattttgccccatcaaaatcgtatgttcttgaaagataatagatatcgtaaaaatctttcattctgcctgtcagttcaaagcgttgcaaagttgcgtcaaacttttccgctatggtgctctcaatagagtaagtttttatcacaggttcttcaaagtctgaaagctgcgtattgattttacgctgttctgcttttggcacgataacatctcctacacctatatcaacattgaacggtactcgtacattctttatctgtccgataatctgtgtgctgataccatgatactttctctgcggagaaatttcctcaaaaccttttgcaatcatcttgatataatcattgcctgtcggtgtgtcaattattttgtaaatcaaatccttaacattatctattgaatttgaatatccacggagcaggaaatcaacatcaatggtggctcgtccttcaaagtttgtaagagtatagatgaataacccgccttttagcaccagaaagtcatcgtaaccagattttgagagttttctcaaaaattcttcctgcataaaaagctgtaaacactgctgataactgataccagaagcctttgctttatttttaagctttgccagaacagaagccgctatatctgccattacaaccacactcctatcaattccttaactcttttttgcacacgcaaaactttcgcatattccaaaagattcggtatattcttttttgagtcttttacatagccctgtaccgccttattaaaaatctccttatcaatcttattcatattccgtagcacatcgcaaatagtacggtcacggtcataaatgcggactttatgggaatcaatttcaccctgggtttcgcccagcgtaaccaacttggactctacacgatatgcctttataaacggataatcgatttttgttcgcctcttagagacatttttatctattgcaaagctccattcagcaggatttctgtcactatatctataatagaatagagcggtctccatacaaatcactgcatcgggaaacaatcgattgataatgacaacttcgctttctccgcaatcttgcatccagtgatagtaaccttgcctgactctttcaattaatccttcgtctaaaagttgttttatatctgcataatataactttgaggctgcaagttcagcggtagtcataacataattataactgctaaacaacattctcaaagtctcaatatcttttttccgaaacatatcttcacctctattgaattgcccttaattaaatcaacgattgggtaatttactatattgtattcgatttttctatttaagtcaatatatagtaaagtgacacttttaattctttcaatgaggcagtttgatagtaagcgtaaaaccctacgcttacagataaattaacgccgctagattttagcggcgtgcttttctacattccgctggaagttctgttgaccaaggcaacagatgatccagttttgtagaatctatgtttcctttctcatcacggagttttggaagttctgtgagcagctgtttaaaataataatacggtctcagattgttgagctttgctgtttcggataagctgtaaataaccgcacttgcctgtgcgcccttgaccgaatcatggaacatccaatttttctttccaacacaaaatgtacggatggatctttcagaggctgaattatcaatcgggacattgccatcagtgagaaatacttttaaatattcttcctgattcacactgtatttcagaccctcagcagttttccctttgggtggtactgttatatcagcaagttgtttttttacccacgtaaaatattcctcaaccagtggctttatgttttcctgccgctcctgaagacgttgttctggggaaagtttttttaaagcacctttcagttcatatattaacgcaatccggcttaatgcctgatacgaaacggagcgttttaccgcagctgcatctgctttgtttgcaacttttattgcatccgcataatcgcgacgcgcatgtgcccagcaattcgcgttcgttaatccgggaatcttatcttgaaggagatgatattgttttaatccatcagtcacaagcactccgttataatcccgataaaacgcaagaggcagttcatgatttctgcctttttggtattcgtagacaacaatcggacgttctttgaaatgttcaccggaccggtgtacccacatataacttttgctcccgggactgcgatcatcatgaattacctgtgtaggcgtctcatctgattgtgtaactggaagtttaagcagctcctgcttcatccgttccacaagtgcagcgaaataacgattagagctgttaataatccagtttgccattgtctgtctggaaatgtttaccccattacgctggaattcctgttcaatccggtaaagcggtgaagaattcacatacttcacattcaaaatagaagcaagcagagatggcgtgacaatactattagggaatatatcttttggtctgtccccgcgaagaaattcatcctgatggtaaccatcggtaccaacataaacttcgactgtatgaatttctacagtccaggattccggttcatggcgcagacgtttgtatgtttcatccggcatacgtttccagtttccctttccgtaaaaagcatctaacgcttcctctgaaacagcatgaggagggagcaactcttccgggaaatttttaagatcaatgtctcgctggccttttgttttctttttgcgtggctttactggaagtagttcatctgcttctggttcagctgcattttcatcatagatagcatctgcttcatcaaaaaaagacagctgtccatcaatagacttcatagtttctgtactgcgtccaaaacgattctgattggcaatccgcacctgttcaatgagcttttcaatgttttcatttaatgcatcaagctgtccctgcatcgtcaagatgatcgtaatcagttcttcacgattcatactattcagtttatcaagtgtatgtttctgactcatctggacgctccttcactttactgtactctattatacaataaagtattagaactggcgaatctgttataaagcaggttccgtcaaaatgcctatggacagaacagtgtaaaaccttcatatgcagtaaggaaatatagagttttcaaggttcattttccccttctgtaaagtggatatgacactccagagggtttctgccggtgctataaacacatcacacagaccatatatatcattgaaaacagaagcataaaatttctctgttttgcacaatgatcatttttttaggatcgacatctttgatcttcggatccaggggatttaaacctaacatcagatagttgaattgttcttccgtcagttcagccgcttcctgtgttgtccgtggccaggacattcttccatcttcaaatcttttataaagaagtaagaagcccgttcccatccatagcagtccttttaggcgatcggaacgttttccgcagaagagaaataaagttcccttttcgaatggattctgttagtatttatcacctatgatcatagccagtccgtcaatcccttttcgtaaatcaacggtaccacaggccaggactacgcggcggataccagcagtatcctcaagcatgacaaatctcctgtaggatttttgacaagagcgtatccgatatatcatttgaaactgctattgtcaaagctcccgttttaataactgcagatgcacgtattatttcgctatgctgatcatcaacagccattctttctgtcggcattgtcatttcagcaaaagatatgtctgtacaattcgaggatgattgcaacgctggtaaagcgatgccttgtttttcgaagagttcatttcggaatttccgttgccagtaataataagatttttcgctaacctgattttctttcagccattgttttgctgacattccatccggtctgttctgacattgaagcagaatgtctttccacatagagtaccggacggtgtgtgttatttgatccatggtaagtgacctcctaaaaaaaactaatagttttttgcatttttttaattttgccacaaaaactctaattaatctaggcgagcgatttgacgcttacttcattacctcctgaattttatttttatatgcaaaaagtgccgttgatttctcaacgacactcaatgtccaaatcgatataaacttgtacttttaaatcttgccaaaaacctttacgaacagtatgccctgtcaatttcagatacgccaagacttgttcttatgtaagcgtaaactcaaatgaaagagctattttagattgcacccctagcagcaacctgtgctgcttctaggagtgcaatcgttaaaaagaactacaactgctctctataaaaatggttcatctaagtcagttacatcttcctttttatctaataacccctttgaaattaaatactcctcatgctcataatatatcatattggaaaaatcatctgcttcttctaattcgacaaaatctgttgctcgcttctccttcatatctggtaattctttatatattttattgccattgtaggcttttacgatatctggaaataaacaaagcgtggattcagataacttctgcaaataactaatacatttatttttataattcttttctatagaatctacataagctatatatccgcgtattttatcattcatggtataatcaccagtagctacttcataatgaatcattgctcgtatacttcttttgatttctttgggagcctttaataaactgtcatttattgttacccctaatacttctttatgatttttaggcgtcatgaaaacagtcttctttggatttaaacaaaatccttcatcctcaactatctttttaaccataccatatatttttcttaataactctctatcgtcacaggaaaatgccaaatcatcagcgtaccttgtgtatacaatatttcttttattacaatatcctgctattctcagatctaattttctacaaatcaaatttgcaagatatggcgatgtgacagctccttgcggcaattcatcatcaacaacgcatatatttgtaagcatatttgatacatcggcattatatccgatatttaaaaaagcataatacactttttcacgcttgatagacggataaaaatttttcaaatctaattttaatacatacaaattatttttatgcttttctgcacaatacaccaatggagaaccttttcgcttccctttagtaaatccatatgaatattgagaagtttttattttatataaaatattttccaaaacccatctttgaactatcttcaacgccagtgacggtgcattgatctttcttttatcaccatcttttttcccaataaaaaaggttttataccttccttctgcaccttgttttgttaaccaataaacaagcttaacacttaagcttaactccttaactaaatcatcaaagcaagttaacattggaagttccaaagactcaataactgttttattactatattttttcataaaattagcaccgctttcttaccttaaatctctttgtctccaatcaatggagtaagttcactgtcgtggagttactccattgattggagtaactctgtgtttgttaattttcttaggaagacagaaccatcttccgtaaacagatatgtatctgtaacgttctaagaaagcagtactaataatattggctatatataattttcaatcttattttatcaataattctcgtcctattttctaaagaaacatatgataaaagaagatttgcaaagccatatcctttctctgtaagcttatatttgattactttcccattagaatcttcttttttaatcaagccttctttaaacagtctttttatagcagacgaataaataatatcaaattcctctatatcgtacttctttttatacaaattcttaagaactgttaccaaattctttacatttaattcttgataaaagtacaacaataaaattataaaataatattggccagaaatcaagtttaaatccttaagtttgggttccttccttttataccctaaataccaaaatctatttcgtaaatacttttttatcttttctaccgcctcatcaatattgttattaaaataaattatattatttttatttttcatcctaacatactcgacaggaccttgcctaataaagcttttagcatttttatactttgtttgcaataaaacaactactttttcaagcgtttcgctattattaacaaacgctcctaactctgtaaatgagccgggactttcgcaaacaatcaaaatcacatcgctgttatttgccaaaaatttttctaatgttagtaaatcatatttctttctattgagcatctccataaacatatcttcgggatataatattgataaattggtattatcttctaatttgctcctgataatatctctataagaagtcttttcttttgtgcttgccgcaccacataaaaaaagatcaatgtttccatgttgtatattacagaagattttattatatatttcatacactatatccaagtcttccattagcaaatccacctcctttcacagaaaatactgttaggcatttgcgaaacgccgaaacccgcataattacggtgttttttattgcaaaaataaaacaactcctcactggtttatggtaaaattgaattgcctaaaaacaatcaaccatcctcctgaaaggagttgcataatactatgataacatacaaacagctttctttggcagatattttctctgattgccaaaataaattcaacaacgataaatatgagttccttgaacttctctctcataccattgacctcgatgaaattgtcccggtctccttcgtttctcatttccacgctgccaccggcagacctcgtacgcatcaactctatccaatgctctgggccttgttattgcagcgtattttttccattcctacagtttctcttcttattgtgttcctcaaatattctcaggaactccgtgacttctgtggctttgatatcgttcctgatgattctaaattcacacgtttcaagcaggactttttattggacttacaattgatgttccatcatctcgtggatttgacggaaccaatctgccaggcactggatgcttctaaagcttctatgttcctgtttgatacctccggtattgaagcctgggtcacggaaaacaaccccaagtatgctaatcggattatcaagcaactcaaagcttttaaaaaagcgaaaggtctggatgattcttatgatccttataaagccgcctatggttctatgcctgcccacgctgcggctaatcctgccattcagcagatgtacatcaacgaccatttctgctacgcctttaaatttggtatcctgaccaacgggcttggtattgttcgtgatatcaccttctacaataaagcatttcttgatgcccatccggacatcgttgtagaaaaaagatcagattctccggacgatgacaagagccttgcagattccaaagccttaatccctgttttaaaggatttcttccagaagcacccactcattaaccccaaggttttccttggtgatgccgcctttgattccacccagatttacaaataccttttggaggaagcgcctttcgagaaagcctttattcctctgaacgggcggatttccctggaaggttcagactgccccctcaacgaagacggcattccctgctgccccaaggacccctccctgccaatgaaacgggaaggaagcaaatcgcatctgcgctgtggtctttccaccatgaaatttgtctgccccaagatgaagtggaaatacaataaagaaaccaggaagaccaaacgggtctgcgagtgtgggagcccatgtacagattcttcctgtggacgtatgttctatatctatccggaaaaaaacctcagggcatatcctggcactgtacggggcacacaggagtgggcttccacgtataaaatcagggtaaatgtggaaaaagcaattcaccatttcaaggacagtttttgtgtagctggacggaaaacacggaatgagaaaacacttcatgcagatctgctgcttgcgggcatttcccagctcgtaaccgttatggttgcagataaaattcataagaatcaatatatccgcagcttaaagccccttatagcatagccgctccacaatagagagaacctgccattcccgctatcagtgcgccctttttccaccttgcgctcattttctaaggacattttccacttgactgcttattcacctttctttggcattcctatcctttcaaaatccactcgttcttacatttttaatgtgtttcgcaattacctaaaaatactgtttattcaataaccccaaaatatctcaacgcatcctttatcgcttccactttctctgccgtcggatgttttctcggctgtttcaattcctctaccgcattaggagcatcatacatcggcaaacctaaatctctcttaacctctgcaaaatatgcagtatgcactttgaagccgtatttcgcttctatgtactcttttattattttgtaggtaactcgttctttaggattgtaggcttctgccctttcggagatttcctttaaaggaactttaccttctccctcgccaaattcgacttttacattgattacactgtcaggttttttgtgggaaagcagtacaaccgtctcaacatgtgtctctttcacccgtaaagcctgtatcacatcttcctcaatcgggaacgaatacactatactcttcactgcatgtccttcctgcttctgttcttctggcatatacagcttgatttcctttatcatgcattttatcagttcccgtttatctctgtcattcattttatcataaatcttatcaaaggacattaagatttgataaatcgcatctatattcatagattcctgctccgctataagcattctctttttgcaggattctatcatatcttcggtatcatatatcttgtcatagaccttattcaatcggcggttgaactcatttcttttccgctctgcatacttatcatcctgtaggttatcaatatcctgttccagattcaaacggtttcttgcaagctttttcagctctttttcatgagaacagatttcttcttgaatctgtgtgatatctaccgctacacctatccgctcttttatatcacgtgcaaacttctggttacgcaagagcttcttcgtatactccaacacttccttttccagtacatttgctgatattccattacgtctacattgctttgtccctctggctcgtttataatgaccgcagacatacgcaaacctctctctttttgtgccatccttatttgtccattgattacagtctgcattcattgccgaaccacattgcggacaacgggcaattccagataacagatgtgctctctcttgacttatattatgattaccccatgatttctttttagagagttcacgcaatgcctgtaccttttcaaagtctgcttctgatacaagtggttcatggctctgaacctcactcattgtatactctttttgaggtacgagacgatattcattgtctgttccctgtatcttctctgttcttcgtctcccccatgcgattttgcccgtatacaagggattatccagtatacgtttaatctggtctgctctccaatctgtaaactttggattaacggcattaggggctggttctcttgtgtatccattcctattaaaataggatgctatcgtggaataccccatttccttattcagatacatatcaaatatcatgattactatttctttctgaccgtcacgtggcacaagccgactgtctttaagcatataaccataaggagcaaaaccaccattccagccacccgactttgctttttcctcccgtcctaacaggctttgtgttataatattctcccgttccagctctgccaatgcaccaagaattgtaatcatcatttttcccattgccgttgaagaatccaatccatcctctgcacacatcagatagacaccatactgcatgataaactccaatgaatttagaacatcctttgcgtttctcccaaagcgtgacagtttatatacaattacataatctgttttcaaagtccttctttttatttcatccagcattttctggaaagccgttctcccttcaatgctctttccgcttttaccctcttccacatagacaaaaagaactttcattccttgcctttccgcatattcttctaaataccgtttctgtccttccagactatatcctttcacctgccgttcactgctgacccgaatataaatgacacatgtttttcccagtttagaattatacatacttttcccttacttagaaaacggccagccccttttattgaactgaccgccgattttattctttctccactttatcttctgtagcatactttgtgactatgttagacagtacattgataaagttctggtaactctgctgttgttccatttctgcatcttctctatgattaatcggaacattgatttctactccgttttccattctgtatgttttataaccatcgtaagaatcttttttcaagaaatcccccctttccttgtatattcgtataccgaggggattaaatcttctctgtctattgcccttaaatggctaatcattttattactgaatgctggactatatccagtgtttttcagcatatgctctattgtttccaatcctcccaatgctccattttcttccaagaatgaaaatccctttacggctgacagcacgccgccgtctttaagccatctctgcgtttccaacaaggtactctgggaggtatcaatatgtaattttaatggttcaactgctcctagaaaccttgtccaaaactgacatgttttccatcagctcttatttgactggttcttatcttcttttacaaatcgcaggttactaccgagcagatcgaaagccaactgtcctaagtccaaaggatgtttcttgaataacatggcaaaggcatgagccttttcatctctcaattgaatttctgttctcttccagctccctactgcttcatatgatttctgatgcttcatacaaatttctttatccttatcatagaaacggtatgacatgcccgatttcccaacaccgatataaaccgtcttagctgtttccttttccgtatagctactctcaacaaatctatagctgttactattggcaacaaattcttctctttcacattttcttttaatctgctctggtgtaaaatatgggatctcatttctatcatctatcgctacatccagtctggtgagatgaaagttatccactccgcagcgtttctcacacagccagaaaaagttcccaaaggtactacctctcatattcataatgcggtatatttcatcacatcctctaccacttagtaccagataacatccgtgtttctttgagcctttctcttctgtcttttcatctccgtagaccttaatacttcctgcttgatatatactctgatatgccttatgcttcaccttcgcaggacgcttcataaatatatcaactggcaattcaagaattttcgaaatcacctcttccgctgttatgctatcgaaaataatgctgatataatcaatcttaatactcagattgtcccgttttggtatattatcgtctcctttcttttttatctatttcagcacattttaaaaatggctctaaacgttgattcctagtcgtttttttattatctgtcatgtatatacagggcggtgttacttattcgccctgtgggaacgcctgccggcgtccctcccaggctcttggtactttctgccttcggcacagtgccagagctaccgaaaccgtatttcccgcctaaaagtagtaattaacccttttagaattaaaatagttatgttataatgcttaaacaaagcgataattaacgccattaggtttaatcaatcatttaaatacataataaccccgaaaagcttatttgtcaactcttttcttgttgattaatatgttttttaagcctgttcggttagaaaggaatccgcatatgaattatgaactattaggacagaatattcagactataagaaaaatgaaaggctggacacagcaggagctgtcagacaaaataggcatcaatttacaaagcctgtcaaagattgaacggggagtaaattaccctacccttgatactttagagaaactcacacaagccttagaggtcacaccaaatgaactgttatcgggcaagttaaaaaccagctcacacatgataactaaaatatctgaatttcttgtaaaggaagaagccctcaacgtagaacttgcctatgggcagtatgacagtccccttgatgaagaggactggattgcatatgaattagaaaagcttcgggcatatatacttgaatatgtgaatgccgataagcgagttgcgtcagatctctatcccgtcaaggactttatccagagcttaaagtttaaaaagctcctttcccgatatgacgattacctttgtcatgacttatttggtgaaacactaagcggacataaagtgcctaatccatacgtgaaggaagtagttgaaaatatgattatggatgacacaggcaaggttcatcgctcgctagaatatccagaccattttgactgataactgctccatcctctcacggaagatacaacaaccagaaaagccttgtcaagaatgctacgcaccactacgtggcaggttcttgacaaggcttttctggttattgtagatggtagtcaagaggataaagcaaaaactatacaaacttgtttgtcttctccccacatacctatattttctatttctcaaagttcatgtatatttcttttgtcttatgctgtgattctattagaatggattctaccgccttcatcgcttcactccccttatcatgcagaagctttaatcctttagatacatccagaaatatggaatcatacattttccgatagacaccatccgatatttcctgcacttctctgcttctaatatagtccccttttttcatcatatccagcataatcaaaaatcctgcctgcaatccgatttcggtatagacatccgtcaattcactagccaatgcgtccacagcatctatcagcttggattctctgtcagcgtcgtaggttaaggctacttcttcaaattctttaaatgcttcatccatccttatctcgtagcctttatcttctacatgtggcttttcttgatagagcagataatctgctatcccttttattgtagcctgttcaaatactttctcaacataattcatcttttctcctccaattaatggtatacggctaatttagcacatttttatacgcaagtcaacggtacaccgttaatatttgagtgcaaaaaggcatatactttggttaaccgtacaaagttaactggagggagaaattatgacttattctgatgctgttattaagagattaactgaattatgtaaagagcgtgatattaccacaaataaacttgctactttatctggtatcacacaatccactgtagataatttaatgaaaggcaagaccaagaatcctaaattgaaaacactacataaactggctgttggattagatatgaccgtttctgaattattggattttccagagatgaacgaaacggcatttgaggatgaataaaatagtcatctgaattaccacaattatattgttaatatttagaagaggattgtagcttatatgattattgacctaaattacaatcctcttatgtggtcacactaataaggtatcagaatatatattttgaatttaatgtataaccataaatacttctcatttccgccaaaacaaattcaacataatttttagcactatgatacgttaaatcccatctttctaaggttcttgcctccatactatgtcctgccatattccttatatctccaagtgccgagcctatactagcttgtttattatgtattttattatctatatttcctgctgcatctttattattatataaagcattgatgacctgtccaataccattttttgtagatacattgacccctgcttgagacgccactcttctaagaaaatcttcgaatgccctacccgcacattctatagcccctcttgagtcatttgtacattttttaaatgcatcaaccaattctccgacttctgcagacgataacgatgaaaaaaactcagctcctagtatattacttatatacaatctgattgtcatatcatcatctaaattaaaatctgctgttgtactgactaataattgcgagctaatacgttcttctaaaaaaatcttgtttgaatcatatgtaaatatacccgtggacattccccaggaaataaataaatccttgagaaatttataatcttttccttcaatttcgtatgatacatataccttccttgctgcttcatctaatgtggtatcatttaattggtattgtataaatgttatgaatggctcgtattcctgtataaatttcctcattacagcaaccttaatttcatcattaggtgtttttcctaatgtatctgcaaattggttaatattttcatcttcatctattacatttaataatttacagatagccagactgcttcgtacatatgctacacttttactcgtaaaattttgtaattttttgatgtcgtacgatatattattattgatataacagataatatcagcaacaagtagaagtggtacgttatgacttggaagtttattacccatagatatttattcctcctcaaactttccataagcatacttaaaaaatagttttattttttcatctggccattcactcatatcaacctttattgtaatatttggcattcctgctgtgaataccggcttatccattgcttcctcaacgttttcattgttaatctttaaagaaggacttaactctccaatctcgtcttctacatctaaaccattatcttgaactatttccccagattcctcatcttgcatttcaataacaggggttacttcgagtatactttctattttttctttaatatcagcaacccactcgattcgagtagacttatttccacgtccaattaaatagttgccaaattcaataaaatccataatactcataaataaggttgtcccctcagtccggtttctctccgtagaacctattgaagccattccccataagtttttaattgtatcaatgtctgttaccgtcacttcagttttcgacgccagtatactatttaatactaactcatacggttcataactcttaactatttttataacagcttctttcttatcatcttcacttgaaaaggctatctcccgtccaatttctgtaaactcgaagctatccttttcgattattccaaaagttttaagtgacgatttagtattatcgtaagcagatttagctttaccaaaaagtgcttttatcgaatcttcatttttgctatttctttttataatatcgattaagcttaatatattttctacagtggtataagctggtaaagcgttaatatttttttttgacattccccaatccatcctttatatttaataacattattctacaccacttatttccatttttcaacacataaaatgtgttgaaacaattttgtgtgttgtttttgttcctaaacatattttatgtgtgcctatcaaagaagtaaattcaattcttctttgctttatataatattaaaaacctttaaagcctcctcaattgccttgaatttttcttctggacaaggcggatactctcttttaggcgtatcaactttattaggtgcttcatgcataggaacaccgtgtttcctcttcacctctgctatatacttcgtatgcacattaaatccatacttttcttttatatactcctgtattttcttatacgtggctttttccgttatatcctctttatccacttccatttcaatgtcgatagtctcaatatcttttttacgggtcaagagtacaaccgtctccacatgcacccccatagggaactgatccacagccctccctctcaccagctcataccccgccccgctaagatacttcaaatcccgggccaaagtagccgagtcacagctcacataaacaatccgatccggtcccatttccgccattgtctccagcagcgactcctcacagcctttcctgggaggatcaactactatcacatcggcatgagccgtctcccccggatgttccttggcataccgcctataatactccggcagcacatcctccgctcttccaatataaaattccgcattcccaataccattaatcttagcattattccttgcatcttcaattgcctgaggtacaatctccaccccatagacctgttttgccttctgggccagaaacagtgaaatcgttccgatcccgcagtatagatcccacacggtctcgtcccccttaagccccgcatactccaaggccagaccataaagcttctcagtctgcaccggattgacctggtaaaaggacagcggcgatatctgatattttatgctgccaatataatctgtaataaatccctggccccacagaacctcgtaactatctcccataataacgttggtattctttcgattcacgctgaccgatacacttgtcattccaggaatcttccgcagctccttgatcagtacctcattatgtgggatcgttttcccgttaatcaccagacataccatgatttcctttgttacaaacccatatcggatcaacgcatggcggatcagtccatgccccgtcttttcgtcgtatgcagcaatgccatattctttcataaaggcaagtatcaactcgagaatccgcttattaaccggcacaccaagcgcacagtctgtatttgcaataatatcatgggttcgtcctgcataaaaaccagttatggaattcccatccttatccatcccaaagggaaactgcgccttgttcctataataaaaaggtacctccattccaactgcaggttccataatccgctccagcagctccggagcaaacccgccaatccgttccagatttccttttaccttcttttccttgaattccagctgtttctcataagccagctcctgtatctggcagcctccacatttacgggcaaaccggcatttcggtataacacggtcggctgacggctctatgatatccattagccttgcatacccgtaattctttttcgctttcataagctttgccttcacaacatcgccaatcaccgcatctttaataaatacggtatagccattcaccttgcctataccttctccatttacacccatatcttcaattgtcactgtgacaatatcatttttctgcatatcgaaactcctctgatacgtttttgagtgcatttgacaattcacagtcactgcctgattcgcctatcatctgcataatcaagctgaagtgcaattgatcaaacacactctggtatacatctttatgttacagttcagactattcagaactgttacacatccagccattaaaatccctttgcgatgggctgaatgcctgcggcctccgcgttttcccaggatccgcataacaattacttttatatagaagtttttcttaaatttgactcaaacagacgattatatcccagccagtctgttcccgtcttgtccttgaatatttccgtcagcgtctgcatcttcgcgtctgcattatctgccaggttcagtgccatagcctccgccagagccggttttttcggagatccatattcgagttctccatgatgtgcgatgatacagtgtttcagctcgctcgccagcttttccggaaagcctgggatcgcgcggactgcctcacttaccatttccacaccaatgataatatgtcccagcagctgtccgtcatcggtatagtcattgtccggaaatgcggacagttcttttgtttttcctatgtcatggcagatcgcagatgcatagagcaggtctttattcaggatcgcataggctccggcaaagtattcacacatttttaccacgctcagcgtatgctccagcaaacctccggcaaaaccatgatgtactgtcttcgccgcagaatgtcccttaaaggcctttatgaattcttcatcctccacaaagtaatactccactgcctgacgcaggtaatcgttggatatctggcgtatgtaggaacgcagctcctcaaacataccgtccacactcttatcggatgtcggcatataatcagccgggtcgtattccccctctgcggcttttcttatctgtttaatattgagctgccgattgttattgtagctgataacctcgccgaatacctcaataaaatctttctcatcgtaatcggctattccctgggaattgggatcccatacttttccgtccagagtccctgttttatcctgaagcagcaggttatcataaggctttccattcctggtctccgcggaacgtttccccttgcagagataaatgcagcgtatcgtctctccttcgtgtaaatcattaatatatctcatcatatcctcccataattgaggctgccatctacccggcagcctttctaagtttccttttatcgtttattcctgacttccaattgtaacagtaaagtctatatccacatacccattcgccccgcggcgctttccttttatcttgacgttttctcctgctttgcagcttatgaccgccttctcataggaaagggtattcgatatctttgtgcccgcaacttcctggataatatcaccattctgtattcctgcagacatggccggggaatccggattgatctccatcacgtagactcccgcgggcatgtcctgcgcttctgacaaagtatcgttgatagttgtgccgtaaatgcctacatacggtacgctctcaccgttcaccagaagttctattgtggcctttaaatcagagatcgccaaggccttggcagtattgttctgcgcgccgccccagattccagggtcgatcatgccgattacttcgccattcatattgaataatatccctgtgcctccggcttctgtcggaatatcggtagccagaatgcttctctgaccgtcggcctgagtttcatcgtaagagttggaacttacaactccatatccaactccgtccgcatacccgaatgtattgccaagggcgagaaccacatcccccttagtcgtaatgttggaatttcccagaaccgctactttcacagcgttccaggtcgtatttgtaatcttggcccgcggaatcgcaaacactgcaaatccgctgttcttgtcctgcttcttcaaggaggctccgtactggctgtcatcagcaaaggtgatcttccacttttcagcatcctgacatacggaactatcacagagtatcagcagctcctgcccattgtccgcggcaatgagccctgcagctcctgcactaggaccggtatccacagaaaatgcggtgtcttccctgaccgggttcacagaaaccacacacttgtccgcctcttttgcagtctcgtacacacttttcatgatatcctgaaagctgtcggcatcaagtacaggcggcaccgtctctccttcggtagattctgcggtctgctgatcgtccgtctcctcttcgtcctccggtatggttacggtcttgggattccccagaaatttgttctgcgcccacggtttaagcgcaaaaaaactaaggcaggcgaacgccccgaaaatcagtccatatatccccactctcgcaagctgtgtgaggattttctttctggtgactggtttgggtttaatcgtctcctgcaggaaagaaaactgttcttccttctgctcctcatggccctggtccggcttctgtttcggatcttcatcgtacggcatagactctaatctcctttagtttatagtataaccgattcatacggattgttcaatatttatccttttcaatatgcgttaaatagggtagaatgttactgtacaccattcggacgtgtacagtaaacgatagaatttacctgtgaactcagataaaaggtgaaaaagatgaatcaaaagactttaaataaactggaatacaataaaatcatagctatattggaggagcaggcctcctctatgagaggcaggcagctctgccgcaagctgaagcccatgaccgatttggaacgcatcaacacatgccaggaacagacctcagctgcatttaccaggataattaaaaaagggcgcctttctttaagcgacgcattccctgtaggtgaatccctcaagcggctggagatcggaggtacccttggcagcggtgaattgctccgcatctgcaagcttctgaaaacagcagcacgcgccaagtcatacgggcgccacgatacgcaggatgatctggcggactgcctggatgtgtattttgaacagttggaaccgctgacacctctcaccacagagatcgagcgctgtatccagggggaggacgagatcagtgacgatgccagcagcactttgaagagtatccgccgcagcattggctccctgaatgataaggtgcactctacactaacaaaccttgtcaacggatcgttgcgcacctatctgcaggatccgatcattaccatgcgcggagaccgttactgtgtccctgtcaaggccgaataccgaaaccaggtgaatgggatgatccatgaccagtcttctaccggatccaccttgtttatagagccgatggcagtggtccggctgaataatgatttgaaagaactgtacgcaaaggaacaggaggagatccaggtaattcttgcacggctgagcgaagacactgcattatatatagaagagatccgtaacaactacaaacttctgaccgatctggactttatctttgcaaaaggggcactggccctttccatgaatgcaagccgtccggttctgaatcaggaggggcgcatccgcatccgggaaggacgccatccactgctggatccacgcaaggtagtacccatctccgtgacactgggagaggatttcaccctgctgattataaccggccccaacaccggcggcaagacagtctccctcaagacagtgggcctgttcactcttatgggccaggccggcctgcacattcctgcaggagaccgctcagagcttgcgatcttccgccaggtctacgcagatatcggagacgaacagagtattgagcagagcctgagtaccttttcttcccacatgacaaacattgtctcctttctgcaggaagtggatgagaactctctggtgctctttgacgaattgggcgccggcaccgatcctaccgagggagccgcactggcgattgccattttatcatacctgcataaacgtaacatccgcaccatggcaaccacgcactacagtgagttaaaggtctatgccctctcaacccccggcgttgaaaatgcctgctgtgaatttgacgtagagagcctgaagcccacttaccgccttctgatcggtatcccgggaaagagtaacgcatttgccatctccggaaagctggggcttccggattatatcatagaggacgcaaagcagcatctgacagaacaggatgcatcctttgaggatctgctgaccgacctggaatccagcaagcgcaccatagaaaaagagcgcgaggccatcgagacctataagcgggaagtggaagctttaaaaaaccaggcaaagcaaaagcaggcaaagatcgaggagcagcgggaacgtatcctcaaggaggcaaatgaaaaggccggaactattttacgggaggcaaaagaactggccgatgagacaatcaggaatttccagaagttcggcaaagaaggcatctcagccgccgagatggagaaagagcgcgcgcggctccgccagaagctgaaagagacatcctcttccggcacaatgaccgtcaaaaagcctaaaaaagcatataaaccgagtgattttaaactcggagaatccgtaaaggtactgagcatgaacctgaccggaaccgtcagttccttgccggattcccgcggcaatctgacggtgcagatggggatcctccggtcgcaggtaaacatctccgatctggagatcatagaagagccggcatcctacagcgttaagagtatgaaacgcacctcgaaaggaaaactgaagatgagcaaatccttatccgtcagtccggaaatcaatcttcttggaaaaacggtggatgaggcagtatccgaactggataagtacctggacgatgctatactctctcatttaagtaccgtccgtgttgtacatggaaaaggcaccggcgcgctccgcaagggaatccacgaattcctgcgccgccaaaaacacgtcaaatcctatcgtctcggagagttcggcgagggagatgccggagtcacaatcgtagaactgaaatagcaaggaggctaatcatggttgcaaaacaaaagattttaattgtcgatgacgacgaaaatatcgcagaacttatttccctttatctcgtaaaggaatgctttgatacaaagattgtatataatggagaggatgcgctctccgcctatgaaacctatcatcccaacctgattctccttgatctgatgcttccgggaatcgacgggtatcaggtgtgccgtgagatacgcgccaagtcctctactccaatcatcatgctttccgcaaagggcgaagtctttgacaaggtactcggactcgagctcggtgccgatgactatattatgaagccctttgattccaaggaaatggtcgcacgggtccgcgctgtcctgcgcaggtatcagcccgtcaaacccgaggagcctgcggaagataagaccaaatgcgttgaatacgacggccttacgatcaatctgactaactattccgttgtctgcgacgggcatcccgtagagatgcctcccaaggaactggagctgctttattttctggctgcgtccccgaaccaggtgttcacacgggaacagctcctcgaccagatctggggatatgaatacatcggagacacccgaaccgtcgacgtccatatcaaacggctgagggaaaagatcaaggatcatccgtcctggggactcagcaccgtctggggcattggttacaagtttgaggtcaaatagcagagtgccgcagcgcacctggtacaaaaggaagtgcagcatgaaaagtactttgtacttaaaatttattgtcatttatatcatatttggtttcctgagcttcttcaccgtaggaattctgtccagccagctcgtgctggacaggctggaaaagaacgactcccagaacctctaccggcaggccaatctggttgccagcgattacctgccctcctacttcaccggagactccacctcatatgcggtacattcgcagctgaacggtatgaatctgtacctgaattcttcgctttggtttgtggagtcggacggaactatgatcacctcctctaatctggacaatacaaaggcgcctgaggccatcgacgattttgacccggcggagatcgggagcaaccagtatatcactggagattatcacggttacttcaatgaggacatgatcactgttatggcgcctgtaacacagggtttctatatcaaaggatatatccttatccacaaacccgtttctgcgattcaggaagtatgcagccagatgatgttcccgatctatattactgtcgccgtcatttttctgctctccttcctgcttctgctgggattccatttcttcatataccgccccctgcgcaccatcacagaggcggcgactcagtatgcatcaggcaacctgacctatgagattccggtctatacccacgatgagatcggttatctgtccgcgtccctgaactatatgtcctcacagctcaaagacatggaagaataccagaaaaaaatcgtggcaaacgtatcccacgatttccgctccccgctgacctcgatcaagggctatgtacaggccatgacggacggcaccatcccgcctgaactccatggaaaatatctcagcattatcctgttcgagacagagcggctgaccgacctgaccaaggacctgcttactcttaatgaatttgatacaaaggaacttctcctgcataaaacagagtttgatatccaggaaatgatcaaaaataccgctgcctcatttgaaggcgcatgcacgaacaagcggatatccatcgaacttctcctgcttccggatgtacagcttgtatacgcggacagacgtaaaatccagcaggtgctttacaacttgatggacaacgccattaaattcagtgagaatgaatccacggtaacagtagaagtcacaggcagaagcgaaaaggtcttcatatccgtcaaagactccggcctcggaatcccccgcaaagaactgaataagatctgggagcgcttctacaaatccgatctctcccgcggcaaagacaaaaaaggaaccggactcggtcttgcaatcgttaaagaagccatccaggctcatgatgaacacattaacgtcataagcacagagggtgtcggaaccgaattcatcttctctctcagccgggcagattccggcagataaacgaaaaaggcagctgcaaaatagcatattgctatctgcggctgcttcttttatactctatttacattcttaagcaatctattcatacagcatattctgtatagattcctcttccatgttctcctgcgtaacccagatatatccggtatttacctctgcctcattgcccacttccaggaccgtacgtgccgctgctatcacggatgcatatccaatgccgaagggattctgtacaaccaggcctttaatctctccgtcccggagggcatccagctgttcttttcctgcatcgaatcccataagaacgatttcttctgttttctctgcctggctgagtgcggatactgccagctgagtagccgttacattcgttccaaagcagcctttgatctcaggatgcttttccagataatattggatcacatcctcatctgtgagactgtccgcagtgacttccttggcttgttccttttcttccttaacctcttctttatcctctttgtcttctttattggccttattctgctcctctgcgatggccttcttcatatcatccatcttatccaaataaagcgtttcggcaattgtgacgtccggatggccgctttcgatctcactcttaaaactgctttcgcgctccctgcctgtagctgacttcgaatcatgcaccagaagcaggatactgcctttatcctctatctcgtcacagagtttatatgcgccggttcttgctgcctccgcgttgtccgtcttaatggtacactgtatcccctgataggaatttcccgagtccaacgcgataatcggaatcccgttctccgttgccaggtcaaactgtaccgtacacgcctcagcatcaatgcttgcaatccccaaagcatccggataccgggccagttcctcatccagaatatttacctgctcgtcaatgtcttccactccgcccggagcattataggtcacctttactttgtcatccccgctgtatcccaacgccttattcaaatcctcggcagcctgttcaacccctcttttaatctctttccagtaggcagaactgttatcctttcctataatagatatataggagccaggttcaagcttcaggccatctgcgttatcatatgctgacggggaaatcgcattcaagttcccctgatatggcggttcctctgtagtatctccggtaaaggtaggagtatcctccttcttgctgcaagcacaaacggtcaaaatgatgcataacatcgcagttgtgatgattgtccattttctcttcataaaataactgcctccagatcttatatgctgtcccagattattacctatatactatacactaatcttgtgaaaaaaaaaggaatattttcttaaatttaataaattttatgaaaataccggaaacttgatgcctggaagccatgaattccatcccgtaaggtgattaggttcccaccctaacgaacctgatacttgccagccgcatataggggtggaagtcctatccgtattcaagataaatgcttattgaaaattgtacctgatttaaagcataaaactgcttgtatatttatcccatttgtattagaatggggatagtggcagtaagaatgatacggctgcccatttatatcataaaggaggatacatactatggcacacgtaattaatgatgaatgtgtaagctgtggttcttgcgaaggcgaatgcccagtaggagctatcgcagaaggcgacggcaaatacgtaatcgacgctgatgcttgcgtagattgtggagcatgtgaagcagcctgtcctacaggtgctatcgtagcagaataatttcaaaaatataccgcaaagtgatcacaaagcaaaagggcggccacacgaaacaagaagtgtggccgcccttattaacggacagtcttgtggacaatgagcagtgccgcaaggcagattaccgcagttgagcctatacctgccctcgtccccaaaatctggctgaaaagcccaattgcccagctgccccctgcgccgccaagcgcagcaaatgcaaagaaagctcccattgtgaccgctgtgttctcatgacactcgaccgagatccccgcccccagcgtcggaaaaattaccgacaggaaaagtccagataatggcagaagcactgctgcttcccccggtaatgtaacacccagaataatacacaaggcagacaaagcaaaatgcacgattaatactcttctaatgccgaatctgtcaacatacatactcccgataaaccggcctgcagtcagaaaaacaaagaacaagctcagccacagcgccgcctgtttcagcgcctgtcccttctcatctacaaagaatgcagttatccaggtgatgataccggcttcagtcgcaatatacagagttgccaatgcataatattttcctgcttttttaataagcatagcccccagaatatccttgattcttaatgggctgtcattaagataggtctgttttgggtaacccgtattgagaaacaaaagaaccgccgccaaaataactggcagtatgatcataaatgcggtcttataatctccgcccttccttaagatcaccccaaatgccgcaggtcctatgattgcgccgataccgtgcatcccagccaccaaattggtatattttcctcttttttcttctggatatatgtccgcaaccgccgtatttcctgcatactcataaagccccaatgaaaagccgatcaacaggatgccgattaaaaatatgtatatattaggggcgcaggtataaatgaaaattcctgctgcaatgttaacatttgaaacaataagagctgtcctcctgtggattttacctgtcatactcccaaaaaagagagaagaagcgcaatatcctatgtagtgaaccaccatcaaagcgccgccgacaccatagctgactttaaaagcgctcgtaacatccgtcagcgttgcccctctgacagaatcgcaatacccaaaaaggaaaaagcaaatcatcacgcctgctgtcacagctctcaatctgttgttttctgtcttcatttcctctttctcctttttcatctattccgctcagacgaatggctcctgaaatatataatgccccgattttacctgcttttccttataagtcccattcctgtgcggtatgtatacctttgccgctgtcccacaaggaatctctgtctccatatatatctgtctattctttacttcccaataaacttcgatatttccataggggcttcgatgcctgctccatgcatatgtaatacggggatctataagaggctttaccacaatctccctgtagccttcgcaggctgcatgaattccgccaattttcctgtacatccagtctcctgcacagccaaaagcataatgattataagaagcgcaggttactcctccatccggcttaaccgcctgccacatctcccacacagtagtagctcccatcttcacttcataaagccaggacgggcattcatcctgaaagagaatgtcgaatgcggtctttgtatatcctgcttccaccagcacatccagtaaaaacggaattgagagaaatccagtgtcaagcctgccatcattctcctcgatcagtctgactaacattgcggatgtatgcttcctatattcttctggtatcagatgaaactgaagcgctaaaacataaatcccctgtaatttggtctttatcatccctttcccgtcagtaaatgcacggataaatgcatttcttacattctcatttaattgcttatagtattgcacatcgtcatattttcctaggacttgcgcaatttgcgccatcaactctgtagaataggcgtaaaagcaggtgggaacaatatccatcgtgcgataggcgcttctcagcatatcgacatctccggtctgttggtctatgcttacactcggcgtcagccagtctccaaagtgaaaattcgtattccacagatacttttcccactcttccctttttttatttcctccggtgctgtctgtgctttccggatattcgtgttctgccgtatatcgaatatattcgatccatttttccatcattgcatagttttcttccaaaatgctcttttgtccgtatgcctgatacagccgccacggcacgatcacggctgcatccccccatcccgcagatgtatgggtctgatacggagttgtactattaggatgatatgcaggcagataaggaacaataatggggatctggccatcctccagctgctcttcccgcatgagcttcagccagcgcataaagaactccagtacatccatatttctgcatgctgtcggtataaatatctgcgcatctcctgtaaaacctgctttctcccgctgggggcaatcggtggggacggataccatattacttttttggctccacaggatgttgtgctgtaattgatttagacgctcgtcagagcagcaaaatccacctgtcatttccatatccgtatatattacctgtatttcaaaatcctctggttttggctctcccggatacccgctgattctgacataacggaaaccgtgataggtaaagctgggttcgaatatttccgggccttctccatggagaatgtaggtatccgtctgcagtacgaattctccgatgatattgcgcacaaaatttccatgttgatccaccgtctcggtatgctccaggacaacttttgtgccacgcttcccgcatactttcatttttaccctgccgcatagaacctgccccgtatcgagtattgtttcacccctgggagactgatagatgcgcgctggcctcagtgtctcacatacacgtaccggttcccctgcctgcgcacacaggttctcatacccataatctgctgtacgaaccggccttaattccctcgaccggtatcccggcaggctgaaattttttttctcatcccgcgcgtcataacattccccaacaaaaagatcggcatattttaccggtcccgtctcggaacagcatgtctctcccgaaccaaaccgttcacgctgtccgttttcatacaagacctctatctgaaacagcccggccaataatgtaccatactggcagctgtctccggtcaggcctaccttcccgcagtaccagcctgggcatatagtcatacccagcgcgttatctcctgtcttcagaccgtccgtgatatcatacgtctgatactccagacaacggttataggaggaattgcctggtgcatattccatatctcccaccctgcggccattcagttcaagacggtaaatcccatgtgcggttgcatagattctggcggaacgcagacatggttttactttgaattccatgcgtatcatttgtcccggctgcattttaatgtcttctattttaatgcttgaataggatatttctgcggtctcctgaggtttttcacggtaagccggaacctgcttgggcaccacccactttgcggtccaatcctcttgatataaaagtcccgtttcgaaccatccgctgtattcggcggcttccccatggttactccaaatattggcttctatatcataccttgtaaaagactccagtttccggcctgcatactttattccaaacgactgcccgctttccagcgcgcctgtatcccataatttccgtcctttgtcaaaaacctgcagccggtactgtacttgtctggtatccggcactttactctcatatatccaggaaaactcaggcctcctggtatcaatccccattggatgagtcctgtgttcacatcgaaactctgtaattttcatttttctacccttgtctttggactatagtccaaatagctcctttggattttgatataagattctttctgcaaatttctttgcctgccccattgaatatgtgccttcttccacacactgggcaagtaccatactgatattttcgcgggccatcagctggtgcccgtaaactgcatccaaaaacaggctgtctccgccaaatccattgattttcgtaaccggaactgtatctaagaactcagcaagcgcgcatttacttgcatatggagagataacgtgtgcccagcacatatctatatatacgtttgggaacatcttagccagcgctgccaggcttttatgatacggatatccgatatgaaaaatatcgaattttatatccgggtattctataaagaaatcatttagcaattcaggattgctgtttgcaagaaaattcggataccccgcctgcatgcccgtatgtatttgataaaccagcttgtgttctgcagcaaaatgaaggacaaaatgcatcatatagttctgtaaagcttccccctcgtacagcccccttctccacgcaggcaagtgccgctcttcaaacaggtccagaaaatctttttccgcctcactctttgtagaatgcccgtatttaaggcttcttgcgtaggccagcccgagcttaaaggccactgccccgttttcaacagctgtttccattgactgtgtacatgctttaagccaatcttcaaatccattgatcctgattcctgtgtccgtttcaatctgttccaactgctgccttgtttccggaaatataaaagcatccagcctgtgcactgggcggtaataccgcctgtcacattccaggtcaaaagtatcctggatggcagtttcaatcttacatttctcccttaacacttcttgaaaccttcccggtcttctggcggcgaggaacttcttattcaactccaggatggagtcccacggcgtctgtgagtcaggaaaatgcatcccatacagtccttccaccgttctgtccagctgccggtaatatgctgtgttttcaattctgcttaaatatggctttaacatctgccatttttcttccagctgtgtctgcccggattgcgctgttgtgccttgagataatgtttccatctcttcattgcgcattcccgcactgatcaaatcgtcccgtaaatacgaagataaatattcgctgaaaaaatccaccggctgttccagttcctgttcccagtttggcagatgctcatgtgtatctataatagtaaggtcattgacatagtcttctatcgtctgatataacgtattcattcttcttctccatctgcccaggtaacggttcagtcaggcctgcactgttacctgcccacggcattatcattaaatttggtttctgaccactttagaaatcattaaaaacttttcatattctacgcccggggggcagctgtcggaattcgcaaggataaatgggtatccttccatgtccttcaacaacttttttacatagacctccaattcactgagagaccaattcaaaaattctgtcggctcgatacctcccacaaggaatttttctttaggaagcaccctgcgcgcctctttcataacaatattgccggtaggcgcaggagatatcgactcaatcccatgcacctttgatccggctatcagcccgagaagcgcctgaaggtggccgcaggcatgctgcatatacatctttcggcggctctccagtatttcagaccattcatttaattccggcagaatgtatttttcgtaataggacggggagatattggtggtggatgtatcttcccaagtgaggaagacttccgcatctgacccagcggatatttccactgcaatccggtccaccctgcgtatactttccagtaatgcttccacttcttccggatagtccatcaaagcatataccagttcctccgttccaagccagaattctagcaatgactgaaaggcgcttttcaaatttatctctggcatcagcataggcacaatgagcgcttcctctcccacctctgccgccgctttattgtacgcggtataatccggaataagttctatatggtcaaaaaagtatctggcagtcttaaaatcttcctcttctttaatgggatgttcagataaaaaccacgtctcaccatccggcgtaatgatatatctggcagtcaggcatcctatgggggtacggattgtcatagttcttttatccttatcatatacgtcctcaatggagcaccccttatagaatgtctgatacattctaagatgttcatattctatttttgtaggatcaaatcccctgattaatggatccgcacccatttcctgcatgacctgcatcatgctcttccccctggcctcttccggattaaaatcataccaatatgccagattcgggcaccatggagtgcggtctgtcttctcaccgcgcagtgcggccagcagtctctgttttggtgtcattgtttctttcgtctctattatcttcgttgtcattgaaaccttcctttcttcctccgttttagcccctttatcagtccgtcaatccaggtctaaaacaacatataacgtttttatctcaaacggccttacatctatccagagcgaattgcccccgcagcagatattcgattccatgtcctgtatcaaattttccatcaaatcgcattcccagacctctttcatacaggagccaaatgtgatctctgctttgcagcgccggttaaatgcttcataaaaccttaccagtattccttcacgcccctccgcttttttcaccgtttctattacaatattgttctgttgtgccttcacaatactataacggcccgggatcttcccctcctgcggatccagcagctgtgtaaagaccgtctggttaaatgctttggcgtacgggatcaccccggcctcccgccagtctcctgcatgaggataaaaagcataacgaaacgtatgctccccctgatccgccttagcattgggataggtggctgattttaatagggtcagacgcatatcccctctatgaatatcgtatccatacttacagtcgttcagaatagccgcgccgtaaccatattcagacaagtcagcccatttctgcccgcacacctcgaattttgccgcatcccagctggtgttggaatgtgtcggcctcagtatgctgccgaactgaatatcataggctgcaaagtccgaatgaatatccacttcaaaggaagtctttaaaagcgtatgttcttcgtgccagtcgatccatgtttcaaactcaatatacggaagtacatgatacatatgcatcttttgaacaatgcaggatctctgatattttcttgtaatttctattgtccaccggagtggtccgttttccgtcacggatatggattcagctttgtttatttcccacattttcaggcggtagtattccgtgatatcccatgcatcaaaattatggggcatatcttcaaaagccagaagttgatttccttttccaccctttttcagaacctctctcttctctttcttatcatatatcccagtgataacgccattcgtatccaggctgatcttccagtattggttttccatctctgccgtagtcgctctcacatccgggacctggtgttctgcgcatttcgcttcttccttaccggctaaccggtaagtacggtacccaaaggacggaaggccttccaaaagtaccaatgcttttccgctgtggaggggctgggccggaacaaagccgttcctctcatctataattccgctgcaccagtccggaagttttgcctcggtaatctgcggacaggtgctccctgacgcatggaaagctgccagtgaatggccgtcagtgctgatcagcgccgcaatctcttctaacgcttcacttttgattcctccaaggcattgaaaaacagtttcgtattccatgtcagacacttcatacacctccgggatagatgttccgggaagaatatcgtgaaactgattgcgcagtacagttttccacatttgctccatccttctgtgcggatattgatacccctcccctaagacagaagcaagcgcaccatggaactctgcctccgacagtaagctttcggccctccggttgtatttttttgttttggcgcggctcgtataagtcccccggtgatattccagatacagctcccctacccactggggaaggcaggcttctttccttttttcttccaaaagctctgtaaagccggatatactggaaaactggaacttagggcagccagatatgcccttttcgaggcgcctgccatattccagcatccagtctgtcgtgcctccgcctccgtctccataaccataaggaagaagtacggtgccgctcaactccttctgttggaacctttcataagtcttgatcaacacatccggctgcagaaacccattatacgtactgatcggaaagccctcattcagcccctgcaggtcttcttttggaagcaccgatgttataatataagcaagaacactgctgtcatcaatcccatgccattcaaacaaatcatagggaagccggttatattcattccagcagatcttggcagtcataaaatatttgatcccagatttgtttagaatctggggtaaggtgccgctgaacccaaaagcgtccggcagccataatacttcgcattccttcccaaattcctctctaaaaaacttcttgccatagtataactgtctgaccagtgactctcccgatgtaagattacagtcggcttccagccacatgcctccgtctgcctcccaccgtccttcttccacccgccttttaatctgactgaaaatgccgggataatcctcctttatatattcatacagctggggctggctcgaaaagaattggtattcaggataccgctccataagcctcagcgcatttgtaaaactcctggcggccttttcccgcgtctgttctgctgtccagagccatgcaacatctatgtgggtatgcccgatcccgtatactgcaggcctcgacctctcctctgccttattataaaacgcatcgtccagatataaagacgcctcccggaggctctgtctgaacatctttcccgaagtcctgctgtccctgaagtccagaatgtttaccgcacgctccagaatcgttccaattctaatccgtctttcgtccccctcatgtaattccgccataactttcatcggaacctggagatcatagatcactttatccacaagggcatcaaacagcccatacgaaaggctgataggaaataccgcatcatccatgccggaatacaccgctacctcatacaccagacattcacccggtaccgcctctgtacaaaggatcatttcccggtggttaacatccagcccctgaatcagttctttattttggaaaaccttaaactgagggttggcaatattccagtcatctgcgtgttccgtagaaaactctgccagtagtgtttttcctgcaaacctctctggaacgatcatctcaaatttcatccagcagtgggcatccttccccccccccatctgacagaattgctacactcctcgtatcggccacattccggtggatataaggaaacggggctccttttatctatgtacatcctgtccggccctcttttatgagtcaccctgtatttttccaattcctctatcgttctgctgacccttcctataataaacattctgcctccattctctgcacatccctattactgtactgttcatataccctgacggctttctacccttttacggctccggcagtcattcctgatacaacttgttcctgcatcagaaaatagataataattgtgggcagtataatcaatatggtcgcagcaaacatggcgccgtagtctgttgcatatgcgcttttaaaataataaagtgctacgggtaatgtcctgctgtcatttcctgtcgtcaaagtcaatgcaaactggaactcattccatgcctctatgaactgcagcacgccggctgtagccagcgcaggctttactagaggcataataattgccgcaaatgtcctgaaaaaaccagcgccgtcaatataagcggattcctccagttcccttgggattgtcataaagtaactgctgagtataaacagggatgtcgtaagcccaaatccagaatagacaaggatcaagcccggaatcgtatccaacagccctattgtcttcactgtattatagaccggcagcaaaagcgcggaacccggtataagcaaagccatagaaaacatcaggcgtaaaaattttcttcctctgaattgaaaacgggcaatcacataggacgccatactcatcaccgccaggcatatgagtgtgctcatacctgtcactataacgctgttcttataaaactgtgcaattggagccagtttaaacgctgtaaaataattcttaacactgaattggccgctaaaaattggcgccgatgacaatatgtccgcatttcccctgaaggatgacagtaaaacccacaaaaaaggacctacagatataaaacatatcaatatcacaaaaattccaatcataatctgaatcgttttctttttcatgtaatctctccccgcttatttaacctctccgaccttgtatatccggtttactgcaaaaaccagaaccaggcctgtaagcatcatcaccacaccaatcgcattgccatagccaaaattattgtcacgcattgccgcattgtaaagcatcagaggcatactcatagtccggttgcccggacctccgccagtggtcatcattatcgtgtcaaatttgtgaagcataccggtacctgcaagaattgtacatgtgcctataatgttacgcagaagcggcagggtaatgtatcgcatcttctgtgaatcgctggctccgtctattgcagccgcctcatagatgtcctcatcaatcgaactcatttctgctaaaattaatgccgcattaacagctgcaaagggaagccatgtcagggtaactgcccaaaatgccgttttggaatccgcaaaccagttttttgccagacagtccagacccacagcttttaaaaattggttcacggggccgaagctggggttcagtatgcacaaaaacaacataccaattgcagcacttgagataatgtttgggatcataaatacgccccgtgcgaacttgcagtaccatttttttcttgctataacaagcgcaaatgcgagcgcgatcccaacatgcagcgtgcattgcagaagtatccagacaatagtgtttccaaaagcagtaaaaaaattaggatcctgaaacatcctgatataatgatccaggccaataaaagtcggagaaaccccaattctccattctgtaaacgatgtagccaccagtgtcaccagagagatcgcatacataaatataaacagtgaaactccagggacaagaaaaataataagccatctctttttaattttcatgatttttcgcctttctttaaatagagtttcgcttgcgaaactcgcgcctgcggcggtcgcaccgcgacatctactgcttacgccacagtgcgcatcccaccgggagggtttttaatttaatagagaagtgcatatcactttcctattaaataaactttccggtatgtgttccataccggaaagtcctgtgctgccgttttattcggcctcctttattgcctcatccatttttacggtcatttcctgtggtgtaatgtttccatatgccatttccggatagtatttgctcatagcattcacaacacttgggagcgctgtagaatcaattgttttatactctacctttacatctttctttatttccattagtgatgcaaataaaggctgctcctgtttaaactcttctgtcatctcgatatttgtagtaagcggaaccactccggtcatctccatccgcatcttctgtgcttccccgtcagtgatacacttcagaaattttatagctgcatcctttgtctcctctgtttttgcgcaaacagaatatcccagctcataattggatatcaggctctggtttggaaatgctgcaacgccaatgcggtccatcagcccgtctactgctacttccgggttcgaaaaatcagcagttgcccacatgccgttcgctatcatggctgtcttttcctgacagaaactgtttgatgcaacaggatatccgccgcctaatgcatcctctgttgtgtattccttaagaagagtctgcatcattgtgaggccttttactacagattcattttgataggagtccggatataccgtattcataaatttctttcctgattccccgtctgttccaatcattgctgccagcaccagatttgctgtccagcaattctcccctgtgcttagggaaatcggtataaatccgttctccttcagaatcttgcagttttccataaattcatcccatgtctcggctggttttattttacatttgtcaaacatatctttattataaaagtatccgatctgagtattggcgtctgccacagaatatatccccccgtccggctgacgtactgcctcgattgcgtcctctccaatttgttctttaaattccggatcagcttccaaaacctccgtcagttccattgcctgtccgtttttaaccgccagatccagaactccgttaatggagtatacgacatccggcagttcgttcgtagccgccagcactttcattttatccagataagctgtatcgctgggtagctcttccactacaagttcaatttcgtctccatacatttgattgaaccgctcaataagttttttctcacattccgtgtttggactggttccgactgcactggttgcatagcgcaaaatgactttttcgtcatcttttttgttgtcattcttctttgcgcatccgcccgcaagcattgctgctgacatgattccaacaagtgccacagctgtagacttcttaactcctcttctcataacttttctcctcttttcgttttgtgtttatttgataggtatattctaacatttccgtctttcttttttaatcgaatttactgtccatatatttattttattattgttttccatttctctacctatacttttttcaccctgctcttatacattttttaccttatccttatatttttcagcacttgcctgatataatgccagatgatacactataagaaatagttttcgcaaacggaggttttatatgaaacgccgtatttctatgcgcagtaagataatttcactttctgttatcctcatcagccttgctcttttaatccaaggcggctggtttttttatcattactataaggcccaggtttctcttgcctatgataacatggaagcttctgttgaacagatgcgctttagtataaacaaggctttttctgatataaataacagcgcgctgtcactgcttactagtcctactatgcagaattggcttgccggcagaattagttttaacaggaatctgcccggatttcaggagaacgtctatgccatgcaggaagattgcaagaataacaatctgttcgataataccttctattcctacgggctgagtacggcttttttaatcacccagaattcagaaatacagttatacacttacggtaccccgtataattcaccttcgttcacctttgaagagctgaaagtactatttaaaaaagaagccgacgcggctgtttttatacctcccagtcaaaattccaaagatattttttttattaaacaagcacagaattacaatcgaaacgataccgtcttctttatttttattattaatcaatcctgctttcaagagttattttccggactgacttcagatctaatcgtttcagtcactgatcggaacgatattgttttattcagcaacacgcccgatatggttggtaaggtgtatcatcgttatctggaagagaatgccgaccgctatcctggtaaagacacgttaggttattcaaaacagataaccagcgctcccttccatgtcaatctgttcacctcaacgaaaagtatcaccacccccatcgccgttacgcttctgcagtatgtagcaatcatggcagtcctgctggtggcttttattttgatcgcagtctggtctttttctaactatacgtattttatcaaagatatggtgtccaatctaaatgaggtgaggaatcaaaattaccggacccgtatgaaaatatatagggaaacggatttgaacaggatcagttttacctttaataaaatgaccggtgaatttgaagaactgatcgcaaaggtatataaaaatgagctgcttttgaaagaatcggaaattcggcttctgcattcgcagatgaaccctcattttttaacaaatacgctgactaccattggcgtctccgcactgcttaacaacgactcggaagtctatcagatgatcagttcccttaatgtactcgtgacggcgaatctgaccggatcattgaagggtgatttgtatacggttgtagaaaaggaatatgaatggataaaaagttatctatatatccagcagcttcgttttcaggaacgccttagctgcgaaataaatgtccgggataagcagattctgaactattacattcctaggctgagtgtggaaccgattgttgaaaatgctgtaatccacggtattgaaaattcctctaacaaaattaatcatattaaaatggacatatacacggaaaatggggatttattttttgaagtatccgataacggctgcggctgtgatttcgatccgctgaaaacctcttccggggatgactccggccgtcagcatatcgggatttcaaatatagttgaacgcatccatctgctgtttggggattcttatggcctagagtttcacagttcttccggtatcggtacaactgtcattattaagcttcctgtgctgaaagaccgccctgaccaggattctaagacacttgaaaatgaaagggaggaataacttatgttccgtttgattattgtagaagatgaggcgattctgagaaaggggatctgcaatattatcgattggaccagtctgggattccaattagagggtgattttgctaacgctcccgaagcacttgcttttttcagggaacaccccgtggaccttgtcgtaacagatatcaagatgcccgaaatgtccggtatagagcttgcccgtaagatacatgcgctctctcccgccactaaggttattatattaaccgccttttctgactttgatctggcggtagacgctcttagggcgggagtgtctgattatattgtaaaatcagattttatcagccagcttcccgtatctgtgaaaaaggtgtacgctctgctggaaaacgaaaaggcgaaaatcagctgttcttcacgtgcattttctgccctcatttctggaattgccacatcgtccatcactaacctggaagacattcaatactggttttgccagatgcagctgcagcctcagcagtatatggccgttaaattctcggtctgtgctgatacgtccgcccatgaagaggaacagacgcgcatgtttgaaaagatcattggttttattaaaactgctgccgagcctttcccatccgctgtaaaaagcgatgcacagaattccgtttacgtgcttctttatgcggcaaatacagtccggctgccccagatgcccgaattcggtgagagcatcatctccgctgcgaagaccctttttgcctgcgggatcagcctctcctattcttctgtgcatcaggatattgctgaatttccctctgcactttacgaatgtttggacgcagcagacagcggtgttttgaatgcagcgcatggccttccggaatttcctggcggaagtaccggtcagctgttagatcctattgggataaccaccgcttttacagaaaatatctgcgccggggacacggtagcatgtgcgggccttttgacgtatttttttggtgaacttgaaagcaaacggtattctttaaataaagtaaaaaatatggcaattaatatatgcacactctgctgggacaagctatatagtcctgtagacactatgtaccaatttcatgcaataaaagatatgaccctggccaggctgaaaaattctgccgctgtagtggggttggtggattctcttcttgactttgctgataaatgtattcatctaaaagtctgttctgctagtgggattccggtccctgtgctggaaatcagcgcctatatccagcaccattttgaccagcccgtcaggatcgatgatatagcacatgcccttcatatgaacagcagctatctaagccgtacttataaaaactgcaccggacattctatcatccacgcacttaactattatcgtatcgagcacgcgaaggtgctcttagagaccggaaagtataagattacagagattgcttccatggtgggaatcgaggaaccggcatattttacaactgttttcacaaaatataccggctgcagtccttcgtcgtataaagtgtttgatataaaggagtgattttatgagaatcaaagatattgctgaacgtgctggcgtaagtaccgccgctgtatcgtatgtactgcacgaaaaaacatcacacgtctctgcagagacgcagaaaaaaatcaaaaaagtactggaagagatgaattatgtccctaacatgggagcaagaatgcttgccggaaagcagtcccggttaattggagttattctgcaggatttctataaatatgaccgggaagtcatagccgatcccttttatgcggaaatcttaagttctattgaggcagagatcagtgcaaatggatattacatgctgcttaagaccgtacctgatgaatcagccattcagaagctggcggcggaatggaatgtcgacggcctaattatactgaactggtccggtattacccccaaaaaatatctcgctctaaagaaaaaattggataaaccgttcctctttatcgattccccctgtggtgatatccccgatctggtaaacatagggtccgacgatgaatttggcgggtttctaatggccgattacctgattcagaacggtcatcataaaatcatgtatttaaccgatgccgatgatcccatctcagcccttcgcttacaaggcgttcgaaatgcttataaaaaaaataaaacatcactcatcggtttgtctcaccaactgcttcctgccaccaaagaagaccgcagaaaactttatacaaattccaattccggtttgagagaccatacggctttgttttttgtatccgattattttgcggctgaggcaatgggctttctccaggatgccggtatccgcataccagaagatatctcaattgccggttatgactgtagttacttgagtgcgatgtgccgcccgcagcttacgactgtccggcagaatatccataaaaaggggactgctgccgtccactctctcctttcattcatcaatggagaggagccgccgcattcacagacacactttaaggtagatctgattgtaagaaaatcggtatcgtctaatgattaacaaaatataaaatctctatattgacacagttatgccgccgtgttaagatacatctaatcattaggttatgcgcataacctcgagggggggggtgttaacttgtgtattctcccagaatagaccgcgccttttttcgtatggtttttactttggtacttcccatagctgtgcagcagctcatcaatgcctgtattacatctgctgatattatgatgcttggaagagtaagcgaatctgctattgcaggggtatcgctggctggtcaggtttccttccttctgaacctgattctcatagggatctcctccggcgcttctattctctgctcccaatactggggtaagaaagatttacgttcaatagaagaactcatgggattctctttatgcgccgggctttttttttccgtaatctttacggttactgcattttgcgctcccttgtcagtcatgggccttttcacttcagatccggtaattgcagatcagggagcacaatatctgcggatcgtatgcttttcttatcccttaaattgtggtacttttatctatttaagtatcatgagaagcatggagcatgtgaaaatatcttttattatttacctgttttcgctcctgattaatgtatttctgaattacatatttatatttggtcattttggaagccctgcattagggactgccggggccgcagccggtacatgcggagcacgcttatttgagctgcttttggtatggatatatgaggaaaaatgtaaccgcacggcgcggttccatctccgtagcctattcgtaaagaatattgcattagtcagaagatttttacactttgcgcttccggtgcttatgaatgagctggcctggggtcttgggtacaccgtgcttgcttctatcataggacatcttggccaaaatgtagttgccgctaattcggtcatcacagtattaaggcagctttccatgattttttcagcagggcttgcatctgctgccgccatcataaccggcaaaaccatcggcgaaggcaacaggccattagttttgaattattccagaaactttataaagctttctgtcgtatttggttgtttgggatccgccgcaattttaattctcgcatttgcttcaggttctttcatacgccttagcccacaatccgggaattatttaaatattatgactgtattgaccagttttatatgcatttttcaaagtataaacagtaccattgttttaggtatcctccgctcaggcggcgacacaaaggcgggtatgattatggatctggtgtcactttgggggatcgcattacttttcggatggctgtccgcatttatctggaagcttccttttccagtaatttatatgtttttagtctgtgatgaactcgtgaaattcccatttgccataaaacgttatttctcctataaatggctaaatgatgtaacaagataaaaatctcgtatctatttttataataaggaggtattaaaaatgaccgctgattggtggaaagaggctgtggtatatcagatttatccggccagtttcaatgattctaataatgatggttttggtgatattaatggcattacccagaagctggactatctttgcagcctgggggtccggattatatggatttctccgtattttaaatccccctatattgacaatgggtatgacatatcagactacagggcaattgacccacggtttggtacaatggaggactgggaaaatatgctcagcgaaatgcataaacgggggcttaagctgattatggatttggtggtaaatcactgttctgatcagcacaagtggttccaggaagccaaaaaaagcaaagataatccttatagagactattttatctggaaagacccaaaaccggatggcatgccgcctaataactggacctcttattttagcggccccgcatgggaatacgaacccttgacgaaccagtattatctccatcttttttcaaaggaacaacctgatctcaactggcaaaatccacggctgcgcgaggagatttacgatatcatgcactactggatcggcaaaggcgtggatggcttccgtctggatgtcatgcatgcatatgggaaaacaccaggcctgcccgacggccggatggacggaacccttccagttggggcggaacacttctcttcgcttcctttaaaccacgcttatatgaaagaaatgaaccgggaggttttctctaaatacgatatctttaccgttggagaaacggacgggatcactattgatgatgccctgcaatatacctcagaagccgcaggagaggtaaatacggtttttcaattccagcatgttaatatcgacagcgtatatgaggagcggtggctggctgattccccgctccccgtaaaagctttcaaaagctgtctggcggactggcagcggggactggaccttgaaggctggaacagcctctatctgtcaaaccacgaccagccgcgccaggtttccagatttggcaatgatgaaaaatactgggcagagagcgccaagatgctggcaactattatgcacctgcaaaagggaactccctttgtctatcagggggaagagattggcatgacaaactgccccgtccatgatataaacgaggttcaggatattgaatcgatccatgcatacaatgaatatctatcaaagggcctggcaactcgtgaggagatgcttgcaggaatcagccggaggggacgggataacagccgaacccctatgcaatgggaccgcactgctaatgcaggtttttccgaaaatacaccctggcttcatgtgaataagaattataaagagattaatgtagaatcacaaataaactgtgatgattctatctatcattactatcggaagttaatccacctaagatcgcagaatcccgtagttgtatacggcagttttacggaattctaccgagatagtgactccattttctgctttacccgttcacttggaaaccaggtgcttctggtcactgcaaatatgacagcggaaagtgtggaatacaaagtaccgggagcagtcacctatacaaaaagctcgctttatatttcgaattatcccactggtcagtcaccccatgaccgtgtcctgcgtccctatgaggcatctgcatatctactgttgaaacattgagtattcacactttgaaaaggaggagttaactatggaaatactgcaaaaatcctggtggaaagaagctgttgtctaccaaatttaccccgccagtttttatgattcaaatggagatggcattggcgatctcaggggcatagcggaaaaacttgattatctcgttgatttgggagtggatgtggtctggatatccccctattttgaatctccctatgtggataacggttacgacatttcagattattacaagatagacaaacgatttggcactatggatgactgggatcacctgctttctgaaatgcataaacgcggattaaagctggttatggatctggtggttaaccactgttcctcatcccatttctggttccaggatgcattgcaaagtaaggacagcccataccgtaacttttttatatggaaagacagaaaacaaaatggtcaggtccccaataactggacatcttactttggaggctccgcctgggaatacagcccaattacagatcaatgctaccttcatctgttcagcaaagagcagcccgacctaaactgggaaaatcccgcgctcagacaggaaatctataagatgatgcggttctgggccgataaaggagtggatggtttcaggctggatgtcatgcatgcatatgggaaggagccagggctgcctgatggagtttttcagcgctctgcatccggagctccggtaggaattgaacatttttcgagtatagagaaaacccacggctatattcgggagatgaacgaacaagtattttcccgctatgatcttatgactgttggcgaaacaggcgacgtgacgattcaggacgctataaaatttacgaacgaggcatctcgtgaagtaaatatggtatttcagttcgaccacgttgatattgaacctgagaaagatgaaaatggaatctgtttatccagagcctgcacatacactttgaaaaagatgctttccaaatggcagacgggattactcggaaaaggatggaacagcctgtatctttcaaaccacgaccagccgcgccaggtatctaagtttggggatgacaaagagtattggtcagaaagcgcgaagatgctggccgcggtcatgcacctgcagcaaggcaccccctttatctatcagggggaagaaatcggcatgaccaatcttaaggtaaatagtattcaagaagtaaatgatatcatgtcagtaggcaattattatgaaaggctatacagtagaaaggcttcagaggaacagctacttgctgaaattaatgcagtcggaagagataatgcccgaacgcctatgcaatgggacagatccgcaaatgccggatttactacgggaactccttggctgaaagtaaatcctaactttcaaacaatcaacgtgcgtgattctatggagagccctgattccatatatcatttctataaaaaactcataaaactccgccataaaaacccagttgctgtttatggagattacagagaatattacaaggactcacaggaattgtttgtcttcacccgacggcttggacataccctgttgctgactgcggcaaatatcacaggctcctgcgctgaattcaggatgcctgaagatatacattatactcatagtgacctttatatctcaaactatgaaggcactcagaccccaggcgattgtttattaaggccttatgaagtacaggcctttttgctggaagagacctgcacaggggtctgacccccttgcagcatcaccgtcttaatttgcaaaggggtctgacccctttgcaccatctctgtcttaaattttctggcagaatttgacgaacgatttctggcttgtccttaacactcctatggtataataacacagagcgaagaatatattaaggcaccattttttaaggaggtataggtataatatgggtgaagtcaggtttatgatttctgaggccgccaaacaggttaaagtcgaatcccacgtactgcgctattgggaagaagagctgaatctggaaatcgggcgcacagaaatggggcatcgatattatacgaaagatgatatacaacttttccgctgtattaaaaaacttaaagatgaagggatgcttctgaaagacttaaaaccactcatcccagaattaagagaaacacgtttaagacttcagaaatccactgatcaggagccggtcaaggcaaaatcctcagaaaaaccagcaaagcctgaagaaaaagcagcctcctcggcaattaaaaaagcggttttctcaaatagcagttctcagaaaaaggagccggacaagcaggctgcctctccgggaaagtcctctctgccgcttacggcagccacaccagacagtccgtccgggcaaaaggcagaaagcgccgccctgactgtagctcaggcagaagtcattcctattacgcagcttgaacaggtacgttcactgatcggtgatgtgctgacagaagtagtaacaacaaacaacgagaccctgaaaaaagacatcaccagtacggtcacacaagacgtcatccgggagatggattttatgtttcaggccaaggaacgccaggaagaagagcacttccgcaaattggactgcctcatccggcagcagcaggcgaaccgccgcgaagcagcgcgggaaaatccatttggcaagctcaagaaactgcttacataacaactcaatcagaatgtccgtaactgacacggcatttttaaagggcggaataacaatttccgccttttttgcattgtccttcaagctgcatttacttgttttttcctcttgccatgttataataaaaagagtgcatttctaaatctaaatccctgtttacagcctatgtcctgaatgccctgacagccagtttaatcgtgccacgagttgagaaggcataagcaggcccatataacccggaaatcggaggaaccctatgataaagaaaagaagaaacagtaagacccaaaaaagcagatccatttcagcgaagctcaatactagcatagtcatcattctggttcccttactggcagtcttaaccgtcgtctcatgtggtgttgctgtacgctccattaaatccctaagcgataaaatcctgaatacgcagtccgattatgctgtatccatcgtagatgatttcttcagcagcaaggaagccgctgtcagtatgttcgagacaaatgaagaactgcaggaatattttcggtcaataagcaccccccaggatattgaggcctatcccggtaaggaggaactgaccgtacatctgtcagagatattagagaagatggctggtgaaaatgcgcaggaggcatggctggctgatgaccgaacggacagattcctgttatccaccggacgtattgttccgtcttcactgaaagacctgccgtggtatgaaaccgttttttccagcaaggctgcagccatcagcgaaccttatcaggatccagccacagatcattccatcatatccattgtggctcccgtgtttgatgcccagactgatcatgtgattggatttataggtctcgatgtgtttcttgacagcctggcagactctctgtcccaaattcatgtgggagagaacggctatctggaactgatatccaacagctccgactatatttacagtaatgatcctactgctacaggtaaaaatgtaacagaattggatatcagtgaacaatataagactaatgttctaaacaaaaataccggcagcatggagtttgaatatgaaggcattgattatgtttccatgtcccgggtgtcgcgtaccaccggctggctggctatcgcaacgcttccggtatccgaagtgaatgctccccgcaatcggctgatcactgtacttgcggttgtatccatcctgataattgccctgctgatctttgtgatcctgaagacagtccggaggttggtaaagccgcttgcagacatcagtgccgatatgcacagcttttccgagggccgcctttccattgatatagatatccacggtaatgatgagatcggcctgcttgcagatagtatccgctcgtccacccacaccctcagggagatgatcttagacttggctcatgtactaaaggaaatctcagacggcaatctcaacgtcgacgtaaccgggcattacaccggtgattttgccgccatccgggaagcgctggagcagattctgctgtcactgaacaacgccctgggacagattaacattgcagcggatcaggtttcttccggggccgagcaggtgtctacaagtgcgcaggagctgtccctcggcgcatccgaacaggccggttccgtggaagaactggcggtcacagtcagcgaaatttcgagacatgtatcacaaaatgcccgcaatgccctcgaagccagcagggatgccggagccgtcaaaaacgaagccgacgcaggcaatcagcagatgcaggagcttttagctgcaatggagaatatcgtcagcagttcccggaaaatacggaaaattctgaaaaccatagaagaaatcgcatttcagaccaacatcctctctctgaatgcatccgtagaggcagcccgcgccggggcagccggcaaggggtttgccgtagttgcggaagagattcgcagccttgccgccaaaagcgcacaagcatctaccaacaccaataccttgataaacgattccttaaccgccgcagaggcaggatccaaaatagccgcagaaacagcccaggctatgcagaaagtcatggaaggagtggacaaagtcgccgcctccatcaccagcatctccagtgcatcccaagatcagtccgattccatccgccaggtaacaagtggaatcaatcagatctccgacatcatacagaccaactccgccaccgcagaagaaagcgcagcggcaagcgaagaactctccgcacaggcacagctcctcaaagagttggcggggcggttctcacttagggagttggagtaggccgtgtgatgtgagagggcgaacggaggggacgaaagcgtatgccggtttgttggggctttccattcactaactgacactaagaaaaaacagcctgattttatggaaccaaagagattcactgcgctgtcttgatgacagcgcagctcagctctttttgaaatttgttttggagaacaaatttcatccataaaatcaggctgttttttctaagtgtcagtaagctcattctacgcccctgcaaaccggcatacgcttccgccccctccgttcgccccctcacatcacactacgtgcatccaataactgtaattgaaacccgggggggccgcagacggggggaggtggatcgtattgaattttcgcatggctcatcctcaagtagttcccccccccccaaggagattccgaatgtaatttcttgccgttgtccatagccatccttcttcccaaccagacagccccccagacattcctaccgattgggtgcgcctagctgattgaaagcggagtctggtaccggcgggactttacatgccgttttaaactccttatagcctgcctagagcccgttgcaggaaaaatgaggaaaatggagggttggatttgattcacaaaatcaaatccaatagccgcctttggatcaaaatcatcagattttggaccaaatgcggctagtccctccattttcctcatttttactgttacgggctcttggcaagcggtgcggagtttaaaacggcatgtaaagtcccgccggtaccagactccgctttcaatcagcgccccccataattctactcctgcctcaactcattcccgaaacgcgtgtattgcggcatccatgcaagccgtactgttcccaccggcccgtttctttgttttgcaatgatgatctccgcaattcctttgtcttcggtatccgggatatagtaatcctcacggtaaatgaacatgcatacgtcggcgtcctgctcaatggctccggactcacggaggtccgagagcatgggccgcttgtcggttctctgttctacggcacggcttagctgcgacaatgcgataaccggcacgttcagttcccttgcgaggcctttgagagaacgggagatctctgagatctcctgctgacggctctcgttgcttttgccgccgcttccgctcatcagctgcaggtagtcgatgatgatcaggtccaggccgagttccagcttatattttctgcacttggaacgcatttccgtaattgagatacctgacgtatcgtctatgacaagccgggattttccgattctcccggccccttctatcagtttttcccagtctgtgtcctttaagttaccggtacgcagaagctgggcatctacatgggcttccagggagaacagacggttcaccagctgttcctttgacatctccagactgaagattgccacgcccagattctgtctgaatgccgcatgctgggcgatattcagtacgaaggcagtcttccccatggaaggtctcgccgcgaccaggaccaggtcagagcgctgaagccccgacagcttataatccaggtcaatgaatcctgtgggaatacccgttacgcttcccgtcgtcttggatgccttttcgatcacatccaaggcgttgagtactacctgtttgatcggagtgtattcctggacattgcccctctctaccagttcaaatacccctttttccgccttgtcaagtatctctgccagcggccggttctcctggtagcatatgttcgccacttcttcgttaaccttaatcagtctgcgcagggtagacttctcctgtacgatttctgcatagtattttacatttgcagaggtctgcacgcttacaagcaggtcccttgcaaactccatgctgctgatctcagggggcacgtctttttccttcaggtgctcctgcagcgtaatcaaatccaccggttttcctgcctgaaacagctctaccatagaatcaaacaaaatgccgtaagcggtctgataaaaatcttctcccgtgataatctcggatgcggccataattgcatctttgttcatcagcatagctcccacgacagcctgctctgcttctgcgctgtgtgggagtattctcttaatcgctgcttccatttccataaagcaagtccccttatgcctcttctacaacagccacttttaactcggctgtcacttccggatgtagtttaatcggaacgttgtgtgtcccaagcgttttaatcgtctctttcagctggatcttcttcttatctacatccagccccatctgttcttttacagcggcggcaatttccttgctggatacggagccgaacgttcttccgccctctcccaccttaatagcaagctccaccttgccgtccttaagactggctgccagctgttttgccgcatccagatgatcctgtgcgatcttctcttcttttttcttctgcaggcgcagatcgttcatgttcttattatttgcctcaagcccgagtttcttcggcagaataaagtttcttgcgtatccgtcatttacattgacaatctcgcctttcttaccaagtgattttacatcctgcaataatattactttcatttatatatctccttcctctatcatctggtcaattgtttctttcacccttctgattgcatcaaatatattcgtgtggtcaaactgtgcgccggctgaattgatatgtccgccgccgccgagcttttcggcgataatctgtacattaacctcatctatagagcgggcgctcagatagatcctgccctcatagacagtcagcacaaaagaggccttgattccgctgatatccagcagttcgttggctgcctgcgccgccaggactgtcgggctgtcaatgtcacccggacactgcgcaatcgcatattcttccctgtatacctctgccatacgcactgcttccgccttggcacggtaagattccatatcatcccggaacatctttctgacacgggtaatgtcagctccacaccttctcaaaaatgcggccgcctcaaaggtacgcacgccggtcctattcataaagttgcgggtatcaatcattatccctgcatacaggcagtccgcctcaaccgacggaaacttaatgtcatctacaatatactgcagcacctcagccaccatctcactggtggaggaagaatacggttctacataggaaagcaccgcattctcaatcacattgctgctctgtctgtgatggtcaagcactgctatggtgcgggatttctttaatagttccggacattccgtcatctgcggcttattcgtgtccacgacaatgaccatggtactgtcagtaatataatccagcgcctgctctgaagtcaggaaaatatccttgccgtaagcagggctctctgcaatctcatcgtacaaaggccgcacagaagtcgttacctcattgatcacaacatgggctttcttttctagttccaccgccgcccggtaaatccccatacaggctcccagtgaatccgcatccgcaatcttatgccccatcacgataacctggtcttttgccacaataaactcacgcagggcttccgccttaacacgcgccttaacgcgggtattcttcgctgtctgttcctttttgcctccgaaatatgtaattcctttgcaatctttgatgacagcctggtcaccgccacgcgccagggccagatctatggccacgcgggcaaagttatagctctgggcataggttgaagtattcagccccagaccaatactcagagtcgcagaacgggcattcccgatattcacctgttttacatcctccagaagggaaaacttatccgcctcaatcgaccggtaactctccttcttaatcgctataaaatacttgtccttctccagcttcttgacaatcccgtccacatcgccgatatatttattaatcttcctgtctaccagcgctacaagcagtgactgtcgcacttcctccacactttccattacttcatcgtaattgtcaatgtagattagacccgcaatcagcctctgatcctcaatctctttaatgtaagaattcagctccgtaacgtccttcatatataccgcaatgaaaaattccttttctcttggaatctgcagcagctgttccgcttcgctgaacccttccagagaaacccggcgcagcacaacctgataatctcgttctctgtatgtgacttcaagctctacatggtcattgtcatccttggggaagaccccgttgttaagctcaggaatcagcttgttcagatacttctcccgtttctggttctctaccatatgggaaaagctgtcgttcttccacaagatacgcccatcctccagcgtgattgcgtacgggactgccaattccttcaacagcgtgttttggatccctttgtattgggtagaaaactgaatcagatccgccagaatcagggacctgttgtaaaaatacaaaagccctgcaattaccagatagattacgataaagacagacatcataagccctgcccgcttgtcaatcatgtacatccagacattcatggctatcagcagcaccgtcataatcaacggccactgcatatacatcctaagctgccccttcaatcgcatattctttttactcatgcttttcttcctcatataacctactaaaaagttgcataaactctctgccaatatttctagtatagcacttttttgcctattattctacttttagttttctttcccagtattctctttcctgagtctcagttccccggaactattgtcaactgaaaagcctcttttatccagacgcccgtaaacattattccgtaatagcgtataaagcacagatacgatcggaatgaataccagcatgccgacaacccccataaggctgcccccaatgctgacagctgccagcacccagatggacggaagccctacagagctgcccaccaccttcggatagatcagatttccttcaatctgctggagaacaaggaacataatcacaaagataactgccttcatcggcgcatccataagaatcagaaacgcccccacaatgcatccgataaaagcaccaaaaatcggaatcaacgcggtaaaggcaatcagaacccccaccagcagcgcataaggcagccggaaaatcgtcatggcaatgacaaacatggttcccagtatcaccgcctccacgcactgcccggtcaggaaactggaaaacgttttataagtcagggaacaaacatccagcacctttttcacaagacctttcttcagataggcatacataaccttacggatctgaatattcagccgttccttctgaagcagaatataacatgcaaatacaaaggcaatcacaaaagtagtcataccgctcacaatgcttttagccaccgtaaaagtagaccccagcacactgccggccccatttttaaaaaactgcatcataccgttaagtattttgtcccaatcaatcttaacatcattaatcaacgacacaatttccttattattatcaaacagttcttccacccaatgctgcactttcggcacaaagtcctggatgctggcccccaaagaataaacggtgcttcccagcttcggaaccacaacaaatataacaagggatatcaccccaagcacaaacaatatcgtaagcaccaggctgagaggccttgcaagtttctgcgcccaagtcttccctgctgtcttcttattagaaaacaaagtcttctccaaaaaatgcatcggaacattcaatataaaagcaattgcgccgcccagcagaaaaggaaatacaatccccagcccaaagcccagagcatccaaaacaagactatacttccacagaacaatcagtaccacaatcgtaaacaaaatcaggcccctgatcttcttcaaattctctttgtccaaattcataaattacctgcctttttccactaattaatcagattgtaaccatttaatccacattctaacatatgtcgggggaaatgtgaagtgggggggggggtgttggctggtatggggccgcctgaccaggagggggaggctggacgcatccgagcggtgaccagtcaggagataggtaagtcttttgtttcaggagataggtaagtcgattcaacaggtggtaagtcgaattgttaattagtatcagtttaaaacatccattgccgttatacaagcggtttttgtatcaagcattccaagtggaaagtcgtgaagccaaatgatatatgttttatcaccgtttggctgcactcctacctgtaagcctcgaagtgataaacttacagaatacagtgttttgttgatttttacttctccatgtttgttaatctttcttggcaggtaaccaatcggatattccagttctgctaacgcttcttcgtatagcagggtagattttttataaaaatcggagggggtactcatttgtaaggcttcatgtgggcggatgttgttgtattcttccacccacaaatcaatggcggcttgattggcctctctgccaccaggtatttttccttgaatctccctgcttatatctgcatgcatgcgttcgtgggcaccattttgcgttggacagcctggatcggtacgatccggaagaatgccaagagacatccaccatgcgcttaaggttgtcaaaccaaggaagccatttgaggaagcaaaaggagtaccattatcactgcgaatgattttgggaagtccgtagtgatagaataattcttcaaatacagctttgacagcatccgcagttgttctctccatcaggcggatggtaagaatgtatcggctgtgcagatcacggacggtcagtggaacacagcgttccccctgggacatccaccagcctttaaaatcaacggtccagacatcattgggttgaagagcttccaacttattacgcagtttggaaacagttggatcgggatgccgaaagcgtcgtttgggaatcaacccagcttttcccaaaatgcgataaatactactctcagatggtgttggcgactctggataagcgctcttgtaaagaacggccagtttcttaggcccccaggccggatgagcggaacgcattttaattaaacgaatgacggtatcttcatccagctgattcggagaattagaaggggccttgctctgatccgcgaggccggagaagccaaattccagaaagcggtttttccacttatgtccagttttttctgcgattccgaacttttgacagagagccttaaagctatcagttccacatagatattctgtaataaattgtttacgttgttccataacagaggtctccttccatggcatacagaaacaccttctttcgttggttatttctgtatagtttaacatttggacttacctatgtcctgaaactttttacttacctatgtcctgaaactggacacggaacatattactacacatttggtgggcccttgacgggggcggcggattgggttggttacacaagaagttcaacttcaagcatttccttatgagaagcataagaaactctggggcagcactttcccgtgccgccggcaacaatacgctgctcccgtccgggatcccctcccggtattggccacttgccggctgggatacaccagctgtccaaaattgcactgcggcaggccatccctgacccgaaaacaggggtgtctggaagcgtcttatggctgttagcaggagttaagcaaaaagaatgaaaaactgagggaaatattgtaattccgaattacaatatttcctggccccagcgcgcgaagccatcaggcttcgggtgatgtggccaggttccctcagttttccattctttttactttactcctgcttacaggccataaccagtttccagacacccctgttttcgggtcagggatggcctgccgcagtgcaattttggacagcgtccgttccccattcgcctgctcactccaatacctgatacaaagccacctcatcggtttctcggtttgctgatatgaggatgtcctctccatctctggtgaagtgatatacgtttgcggggccgcagtcatgatccagtatttctgactggtaggattttgtttccttattgtatgtaaaggcgatgaggtttctttccccctgtctgtggcctacgacaagggccggacggttcagcagatttccgccgtagatcgcgtgggtgaactccgctggtttcccgtattcgtatacctgggtaaatacgccttcttttcttttgtaaatgctgatcttatctccatggaacggagacaaaactgccagttctttttctccgtcttcgtccagatcaatcaggacggcatcacttgctgctgtgtcaagcagggtgcggatcgtccagtcgcctccggcagactccggcgggataaactggaatactccgcagtctgcagaaataatgcaggtgtcggttccctggtcgtctacccggtagtagccgtggtttttcagcatattgtcttttatgactttcaattccagctggttgtcttccccgaaaccgcttagatcctccgggaggactgctgcatatactttgcccggcatcgaccagtcgtctttgtattcatggcccgatttgagggcacaggcgattagatatcttataccgtttcgctctacgatatcaaatcggtgtacgtggggaagctctgccagcgtcctcacttcccagttccctttcgagatcggagtgactatgacgatcctggcttctttggagtcgttgggtgagtagaatttgtgtgtggccaggaactgaccgtttgttcccggtacctgcaccatactcattaccccgccaggttctttccacacggtgtccacctcgcgtccctcctggtcaaacaggatgcatctgtccactttctccgctgccaccaggaaataattgcttccattatattttaacggcgctatagaatagcactttgtcagattcgatattacttgcttgcatactttcacgaaatcgttatctcctttcctcgtcatccagtatctttctgaacattttgctcgctgactttagatcctccgcccaggtatcgcttccggtataccagaattcggtgacatacttacggatgcctaattcccaagccgtatggacagcattttcaaaatccacgtgcccggtgccgtatggaatttcgcggaatctgcccggtaccgtctctttgagatgcattgcaaccagatgtccttttccgatatagaggtcttccagcacatctgtcttataggtatgcgcggcatttgttatatttccgatatccgggtatacattcaaataactggaccccaccagggttacatatttcattgccttttccacggtgttcataaactcattttccatcgtctcaaatcccagaagcacaccggtccgttccgccatattgaccgccttcttcagatttgtcaaaaatctttttttcgtttccaggctggattcttcgtagtatacgtcataacctgcgagctgtatgatccggactcccaggtcatccgcaagctgtatcgctttctgcataatctccataccccggccgcagacctgcgggtcactgcttccgagggggtatttcctgtgcccgctcaggcacatggtgcggatcggtattccagtctctgccatcagacggaccagctccagcctctcctggctggtcatttccagacggctcagcttctcatcggtctcgtctatactgatctccacaaaatcatatccggcactttttgcagccagcagcttttctttccacgttaagctgccgggcattgctttctcataaagcccaagcgtatatcctttcatcaaactatctcctttaagcctattcttccagcagccgcatcacagaatctatgacaggctgtttcattacttcaccggcaagcctctgtgcctcttcataggaggtactgcggatctggtgttttacccccgccgcctcgccaggtgacacactgaattcatccagtcccattcccagcagcatttttaccgcttttgtatcgctggcaaactctccgcacatacccacctttcggttatacttgtgccctgcctgtatggtcttgtatattgcgcgcagaaccgcaggatggtaagaattgtacatagccgcaatcttctgatttcctctgtccaccgccagaaaatactgggtcaggtcgtttgtcccgatactgaagaaatctaccttctctgccagttcttccgccatcataactgccgcaggcgtctcaatcataacccctgcctctatctcttcctggaacggaatgccttctttgtgaagttcgtccttgcattcctccagcaccgcatatgcgtccaccacttcttcaatggaaatgatcatggggaacataatgcggatatgtccatatgtacctgcccgcagaagagccctgagctgtgtcttcagaatctctttctgatccaggccgatgcggattgcccggtatccaaggaaaggattttcttcctttggaaactcaaaataatccaggcctttatcgccgccgatgtccaaagtccggatggtcagctcacgttctcccagaagctcagccgcctgtctgtatacattgaactgctcttcctccgttggaaaatggtcgctctccatgtagaggaactcacttctgaaaagtccgattccgtcaatccggaacttcacggcatttttcacgtcttccaggcttcccacgtttccgcatacctccagctttctgccgtctgccgtaacggtgggaagagcgctggattcttccagttccttctggcatctatcaaactcgtttgctttctttttatattcttcaattacttccggttcagggttaataataattacaccacgggaggcgtccatgattacaaagtcaccgggacgtaccgcgtccataattccttctaccccgacaagcgcagggatacccatccctcttgccatgatagatacgtggcttgtcacaccgcccagctctgtgataaatcccagaatatattccaggttcagcttcgccgtatccgacggcgccagatcccttgcaaccaggatcactttttcggtaatcgaatcaaaatccccgtcaccgatccctttcagcttacgcatcaggcggtttctgatatccagtatatctgcagcacgctcacgcatgtactcgtcttccatcatctcaaagatcatgcggaattcttccgcggtttcatgcagcgccttctgtgcgcagtatgactgcgtttgaatccggttcagcacgccctcctttaacgcgatatcttttgccagctccagatgccctgcaaatatgtccgacttctcggccaaaggctccagatctgcaatgacttcctcgacagcacgctcataagctgccttctcagcgtccgcctgcccgacttcaattactttttcctccggactcagatcctgctccctggccacgaacacatttcccataacaatgccttttgaagacgttttactcacttcaatccttttcattgccctgactccttactctcctaatccgcttgcaatcgcatcaatgatggtctttaaatcatctgcttccgactcacctgcacattccactgttatctcatctccgcatttgatgcccgctgccataagaaccagcacgctcttaggattcactctcttgtctccttttacgagagtaacgtcagatacgcattttgatgcgatattggacaggattcctgccggtcttaaatgtaatcctgaagggttcttgactgtgattttttcgcttaccatggttgaattctccttttcttcttcacttttttactttttcttctttaacagaaagtactgcattttgcaagttggcctgtgtctggtattccgctttgcgaaaggcccgccccgcaggggcatacatcatcaagtgcgctttatttatacgcactttttcatactcaggacgtcatcgagtgaactctgaatatatatattggaaacatgctgttccagcacccgtaaaacctctttcagtttatacttgctgaaatacagcttatgtttgcctttctccgtctgacagaccactttgatcctggaggtctggtattcatcaatatgtacggattgaaccagatcccagttcaccgtgtaaaataccttttccattcccttttcggaaaaccctctcttaatgccggctgacccgaaaatagccacaagtatcaggatattccggatattctctaccacgctgcccatgtccgagagcggaaagatcatcaatgcaaaaagtacaatcagcgtaaatgtaaagaaatcatccttgcccttcatcacaatcttacggtttcttttgaggataaacaccacctcaacaattagaacaacaataaacacgaaacataacatataattccatatcatagctctccgctcctttctttatgttcattatatcaccgcgttttttataaatcaatcactttgttcttaattatatgattatttatcctatttataagatcattttcgccttataataaatacaaaagaactttatgaacttttttcataaaaattcacattagcaatatacactgttctgccttgaacataaacaaagtgggcaagcccgcttaagctacctcccctccacatacaaattgaaaaaaccgcccacttctgagcggcccttttcctgcctatccggactattcaatcctgaaccgcccccatgtaccgcccaggccctcaattactgctcggtaagtcctgtatttttcttcatatacttctttataaaacggacgcggcagtacggtctttgtaatcttgacggtgcgattcactgcctcccggtaatcccggtaaattcctgctgcaattcctgctgccatcgccgctccctgggctcccagttccttatcttctatcacatccaccgggatctgcagagcatctgcaaagatctgtacccacacatccgaattggcagcaccgcctgacagacggatggactttggcgcttcccggttctgcagaagttttttcacatgtgtaagatgagagaatacaactccttcgtacaccgccctcagcatatgctttttactgtggtaagcgcttaggcctgcaaatgtaccttttgcaagtgcatcctcattagagccattcagaaacggcaggaaaatgagattgcaatcctgcggttctactgattccgcccagtcattggtcaactcatagaccgagccccccgctgtcctgcattcttctttctcatggctcatcagattcgtgataaaccactccatattgccggccgaggtagggctgctctcttccacaaggaaatatcctgggatacagaacatggaattgagcgacacgctgccgttggtcactggttcccggcggataaattcgttaatgctccaggttcccgctaccatgcacatctgttcctcatcgcacagcccggaggcaattccgcaggcatccacatcaaacattcccgccgccaccggaataccggccggcagattcgtctgccgggcagcctccttcgtcacataaccgcagatatcggcggcatatctgagcggagggagtttgtcatagatctcttccagcccgaacagccccaaaagctctctgtcatattcttttgtggtcaggtttaccaaattagcaccggaaaagtccgtatactccgcatatgcctcccctgtaatctgaaaacggatataatcctttaccgcaaatatgttcttcacatcccggagcacctccggatagtggtcccggaaccatgccagcaggctgacaggctgacaggcaaggatcgtctgacaggatctttcgaataccttgtccatcgtaccgtctttctcccatctttctacatactcccatgcccgcgtgtccgtagaaatgatcccattatacgcgggagtcccgtctcccttcaccatgtacagccctttcccgtgcccggaaaaagagacacctgcaatatcagacgggcagatgccgctcttttcaattgccgtgcgcactgccagtacgttaacctcccacagctgtgtcatatcccgctccgtgtaccccggtttgggagtaatggttgttgtcggcacgctggccgcggcgatttgactcccgtcttcatcaaagacagcggcttttgaaaacgttcccccgttgtctatcccaaccaaatatctcatgttccgcctccttctgtgtccatatttccacccttatctcaaatggcaccctgctcgttgttatcagcggcactgtaccggcatgccaattttgctttcaacacaccggcacttctttcactgtttttatccgcagacacttctcggcacatccggatggttcgggccaaaatgttttaagagcaccagtggttccacccggctcaggttcgtaatcgtgacccctctcccggctgcgtcctctgaaacaaaaaactcatccgtactctgctgcccaaagcggagcaaggcagccgcttccgcatcgtagccccctatttttccgtgtccctgtataaagatgcagccataagcagcaccatccttaatcgtaaccgtccggcccggataaacggtcagctcttttgcggcaatatactcattggcataggtgatccaattttcagtatagtcttccgtccgggatgcggttaccggcggccggaagtaatgtttccgataatgcggatccacatttttctcccagtccaggaggctgaaaatatagtcaatgtcgccctgtctgtccgccgggcattcctcatccaacatctccggaggatacacctccccggaaactatattttcataaacagaattgacatcggagttccactgcggctcataggtcagcaccgatgcaggcgcatgaatgacccctgccggcgtataccatcccgtccccagttcgatcctgtacgcacgggaaagttccgtaatcctcgtatcatcgtccccaaaatgtcggattctttctttgacctcttccggcgtcacatccgggtcaaacccgaagtaggtgtagcctgcttctccgaaataattgttcagctgtttcgggaaataataacactccggtttgccaagcttgcctacccttgccgcgtcttcaaacatcagatggacatggtggaagagaggattttcattatcgaaaaacttggaatacatgggccagccgttataccgccccatcagctcttctcccaccagttctttccccagaaccttgaccgcatcccgcagggcaaacttttcatcagaatcatatgagacgcttacatagctcatcccttcatctgctttagacaattctccgttttgtgcggcaatagtagatgcaaaccagcgctccgttatggaacctctggccattccgaatgcaaaatagtcgtccgggtgcagttttaatctgcggcctgctttcccaaaccttctgggaacaaatgcaggaaataagcggaggatcccttcgcccgcctcaaatgttttccgaatgaccgcctcatcttctgttgcatcctttaccacaagattgccgctcttctttgcctcacgtaatctctcatccagctcttcgctgctttttatgattaattctttttccgtcatatgtgatgtctccttttctttaacccagatttgcaatctcctcacggcagatttcaacccagcggcatgcattatacgggttatgtcccagcgtattattatccttcatgatcaattccgggatgcagtccctggtgcaggccagcgcctttctcaccgttttcctgacctcatcctcgttcattaccggagaggcaagcgctgtaggctgcggtttgagcgatgctatataccggtttcccagaagctccggtatcaatgtccagtccgcccatgcagacatggagactcttctcaggttcggaatttgtttagcatactcaaatctctcagtaacagactcacagcacccaaagcagttcagcccgaaccggctggccagccttttatggtatgggagtatgaactctccgtacatttctgcactcacggtattcgtctcctggctttccacaaatccccacatctcctttgtggtcaccggccgtttcagttcctgctctgtcggaagctgatttgtccagccgaatccgcccgagcccacatatgccccctctgtatttaaggcaagcaggcgctccttctcgaaccagtccagccgtttttcgatccccgtcgtcatcaggtccatcaccttatgtatgtactccggctccagaatgaagtcacataaaaagttatcaaatcccctgagcataatgtaatccaccgtcatccccagggaccaccaccacaccggatgccgcctgaccgtcagaatcccgtcaaaaacctcatgcgccagattcagcacacggtcggactcttcatagtcgatagtaataacaggataatgcagtttttcaaagtcttcctcatagtccctcaatccgccgatcatcttgtaggcgccgcccatctcgccgccctcttttttcatctctacgccccatccatcgtcggaaaaggaataatgtacgtcaaaatatggttcaatcactttgtcatcttttagattttcatgccagtagatctgtttcagaagatgcatttcccataccctggccatattgtcgtgacattccagcatctccggcgtgatgatctcattccagccattttccggatctatgaatacaagcggctgggtggtctgcaggtcattgtgggcagtccagagcctggccttttccttttgaacgggcagcgccgcaatttccgcgacccgctttcccaacgtgcggagacgttctatctcctgaggtgtgaacataagactgctgttcatcgcctggatcggcggaaatcccgtcgccagatgctctttggccggatcccaggatgtatgattgctgttgctcacgcttaaaatagcgcttttctcttttctcattttatctgcctctctttctgtttccaactgcttccccgtctctaaattccggccagttcgtcttccctcttccggttgttccatgcatccaggatgacaatcgcaacaacaactgcaccctgtatcagctgctggagatatgcatatgcattgatatgggtaaatatctggctcagcattccgataaataccatccccaggaaggtacgaaatacgcttcccctgccgccggacaggcttgttccccctaaaaccgtagcagatactacagacatggaaacgtcgcttccatataaaggggaaccagcctgcagtctgcaagtcagaagaactcccgcaaaagctgaagcaaatcccaaaatcacaaataacagaaacttgatctttttcacactgatcccggcatactctgccacattataattgccgccggttgcaaatacatttcgcccgaaagcagtctttgtaagcacataatgggtaataaggacacagataaaaaataaaatggcaatgtatgcaattccgccaatatttcccgtcccgaacgccctggtcgcttgattgacggctgggatcggcatcccattgcagaaagtgagcataatcccttccacggcaagcattgtagacagagtcacaataaaggcattcaacttcaggatcgaaacaaagaaaccattcaccgcaccgatcacgccccccgtgatcaatataaggacaatagacgcaaagatcccgatcctgggcatcagataagcaaaaagcagggtagaaaacggcagaatagacccgacactcaagtcgaattcccctccgatgatcgctatcgtcatcgcgcatgccacgatcccatatacagaaatctgtatcagcagtcctttaaaagtagagaaggaaaagtaactcggataaaaaatggccataaacacaagtaatactgcaatacagacaattaccagataagatttacaaaatttgctgactcgttttatcatcttttccacctcacactttcgtcgcaagcatctcgttttcagcctttgcgctgcgcagatccatcagaaccgctgccagtatgatggcgcctcttacaattttctgcggataagcagttacaccgactacgttcagggcatttgtaagaacacccataatcacaacgcccatcagagttttccaaatacttcccgcaccgccgcccatccggctgcctcccaacagtaccactgctatggcgtccagctcatatccggttccctgtgtgggcgatgcgctgcgcacacgcgaacacaggcagatccctccagccgctgccataagtccggatatcgcatatacgctgattctgatcagccttgtccgaattccggacaggcgcgtagcctcttcattgaccccgatacagtacactaatctcccgaaactggtcttcttcaggatgatctgcgtcgctacaataaagataagaaagattgcaactgtaatcggtatcacgccccagtagccctgtccgatcaccatatagcttttatactttgacgcgtatgcgatagctccgttggtaatacacagtgcagcggagcctaataccgttgacattccaaaagtgataataaaagagcttcccatcgtcccgccagtcgccgatacaaaaataccgttaaaaactcccagtacaagccctgacagcaatgccagaaccatggcgccaggaacgccaacctgtgggatcagcacaacggagattaccccgcaaatagacatcaaagatccaaccgacagatcaacgcctcctgatatgataacaaaggtcattccaatggccaaaagcccggtcgccgaaatctgcttgaaaatattaatgatgttctggcccgttaagaaagccgggttaatgatacctgcaacaattatgataaggatcagaatcgaaagcatgccgtatttacttgcaatatagttcagctttcttcccgcctgattaccctgactttttatcaatgtattctgcctcctctcattcaatggcgtatttcagcacggcttctggattgatctctgcgccctcaagttcgccgcgtatttctccgtcatgcatcacgattaccctgtcactcattgctaccacttcattcatatcagaggaaatcataatgatcgcttttccctgtgctgccagctcgttcatgaccatgtagatttcgtacttcgcccccacatcaatgccccgtgtcggttcatcaaaaatcaggatatcagcgcctgaaaacagccattttgcaataactaccttctgctggttcccgcctgacaggaaggaaaccctctgcgtagcggagggcgccttaatctttagtgtcttgaagtacttctgcgcttcttctttttcaatgctttcaccgatcaggcggaatttatttttgactttctccagccccaccacgctgatgttctgcgtaatgggcatttccaaaagcaggccctgcgtcttcctgtcctcgggaagcaagacgattccgttcttttttgcctccaggggggatttcatattcagcttctgcccttttatctccactgttccactgacggccttgtccgcgccgaccagcagcctcactgcctcggtcctgccggcgccaaccaggcctgccagacccagtatctctccttttcgcaattcaaaagagacgttttttactttatttccacgatttagcgcgcttaccttcagcaccgtctctcctaataccgcatcccttgccgggaattcctgctccagttttctgccgaccattttttcgatcagctgctgttttgtcgtatcttttacagccgatgtatcaataatctgcccgtctctgagtaccgttacggagtcacatatctggaagatctcctccaggcggtgcgaaatatagataaccgtaattcccttacttttcagatccagaacaatatcgaataaattcttcagttcattttccgtaagcacggctgacggttcatccataataatcacctttgcatcaacagacagcgccttggtgatctcgatcatctgcttctcggcgacacttaaattctcaacggcctctctcacatcaatgttgtaattaaggctgtgcatcagttcttcggcctttttattaatatctttccattgaattgccttcttcccctttttcagccgcccaataaaaatattctctgctacgcttaaagacggaaccaggttaaattcctgataaatgatcgacaagccatttttctgggcctctaggggatttttattcataacccgtttgccgtgcatccatatctccccgctatccgcagagtatactccattgagtatcttcatcagggtagactttccagcgccgttttctcctaccagcgctcggatctctcctttattgacgcgaaatgaaacatcatctaaagcaataactccgggaaatcttttggtaatattcttcatttccaatataacatctgacatgtctgacctcctaagttaaacggatattcaacatccgcatgctgttttattacagccggcagcccggtgaacaggctgccgttgaaacagtaagggaggcgggcctcccttacgtttgttattgattataaccatgatcaatactttcacagttttcttttgtaacagccagacattctgtcttataccaggtatcaacctctttgcctttgatcacatctatggcaacatcaagagcggtaataccttcccatgacggagactgcgtgcaggtaccaaggaggctgccgtccaacagagcttctttggattcatcgcccatataaccaaggcccataactttaatctggtcttctttccccgctgcctttaccgcttcgatcgctcccagagccatagagtcatcctgtgcaaagatcatcgccaaatccggataagccgcaatcatatcgtctgtcgctgacattgcttttgccttgtcccagtcgcagatcacctgctgtacgatctcaatcttgcttcccttaattcctttttggaaaccttctgttctgtaaatctgcgcctcctggcctgcaaaaccttccagtgtgacgcattttccgccttccggcagctgctcaacggcaagcttcccaacgacttcaccctcataactcgggtcacagcagaccagagaatcagtcaatgcttccacagattcgtcgacacgtgtattgcagacaattaagggcagcccggcatcgtggattgcttctacaatcgaaacagaacccgccatatcgcttggcgtcaatatcactgcatcaaaatcctgctcgataatgctcagtgcctggtcgtacatcacctgattatccgtttttccgtccaggatctgtagttcaacccccagctccttcgcatgcccttccatagcactgtttaagtatccgaaatatggggttgaaaccagtgcattcaaataggcaattttatacccgccgctctttgcttccccatccgtcttttcctctttggtctctttcgtatcttctgtttttgtttccgcactctttttctctgattcccctgagccacatccgattaacatagacgtaaccaatgcaacactaagaactacactcaacattttctttttcatacgatttcctcctgtttttaaattgttttttgattatcattaaagctttcgtcccagctttaatttcattgcattgatcatgaaaacaaatcaattttcctcaaactttcctgccagctgctgattcaggtcaaacactttgcgaaggccatttacatcatccctggccttgccggatgcatctgcaaaaggactctcctcaataaaatctgctacgtattcaagccacttttttccgacctcgcttttcccgaacttctccgtatacgtcttcatatcctcacactcaacgaataccaatgctttgtttcccagcataaatatgtactcttcctttgttcccgcagccttcagacattccagcagctcatcccatggatgcagatgtgcatttacgtactcctcgaaacgctccggtttaatttcatttacaatacaatattttttcataccctcacgatgccctccatcactttctctttgcgtgaatccgttacttcgctaatctgcctgacgcggcagtataaaatccccccttcccttctctgtatcttttccgttttatctggttggtattttttcaattccagaaaaaacgtttttctaagagtcaaaaaaaattttgattgattgtgtgccgtcccttttttactcttaaaacttgtcttaagcatattcccataacccccttttgtcaatgcttttaacagaaaaacgatttttttgtataaaatataagataccacaccccaaattttatacacaattcacaaaaaacgtttttctctgggcggtttttgtgtaagggggggcgctgcgggaagcggacataaggggggctggaaacgggttagggctgtgagaaggagtaaagcaaaaaagaagggaactccgggcaacctggacacatcacccaaagcccgatggctttgcgcgctgggtccaggaaaatgtgtaattcggtattacaaattttgcccgggtctaccaatcggccaatatccagtcttcgggggcatctgccactgttgattttcgtaccacaagcctgctgtccattttgattcccacgggtgctcttttttccccgggattatcgatccgttccatcagcagctttgccgcctcgattccggcatggcgttttcgtatgtgtatggtggatatagccggttctacaacgcttgatatgaatacatcatcgtatccaatcagttttacttcctcgggtattttttttccgtattccctcaggagcttcaatgctcctacggccatctggtcgtttgcacagaagacaccgtccaggcccggtacgttgtccaacagcgctttcattcccctgtatccgctttggtggctgtaatcgcccctcacgatcatcgtgttttcatccactggtaaatcgtttttttccatgctggttaaataaccctgcacacgctcttccgcgacctccatgatttcagggcctgaaatatgaacaattttcctgcagccgcagtctaccagatgctgcactgccttctgcgaattctcataggcatcaaaatagacggaatctataccaaactgggtgaaatctctttccatactgacaagtgggatcggcttataccgctgggacgccttgatcagcttactcaaatacttctccctgtcctcaccggaaacaagagacacaaaaataatgccgtcaacacggcttgaaatcagattcttgaatatatcctgctcccgttttgccgcatccttgtccccatattccccccgcgtgtcgcagataaccatatggtaaccggcacgctcggtaatcgaagcaatcccttttataatatagggataaaaaacaccgcagatatcttccgttatgattccgatcgtccccgatctgttactcttcatacttcttgcaattggatttacctcatatgacaattcctctactgccgcttccaccttgcgaaccagttcgggactgacatattttgttttatttaaaacatttgaaaccgtagaaatagaaactccggccttttgcgccacatcttttattccatgcatcttcgttatccgtacctcctctgaaggtcctgcaccgctatcaatccattacattataaagtatttccccaaacatatcaatcgggatttagcggcgggttttagcccgcccaggcgcggatggaagggggacgcttaccgtgagccgggagatgctgcggctcacggtaaactggttcatccgaccggtaggttatgccccgttactaaggtggcgctcaaacgggggcagcggatgaagtgggctatgcgtatcatgcatcttgcttaaataaattttaaggcttttatgtatgggtcctttgggactgtttttgaagaccagtatattcacggataacaaggcaatctaaaacttacaccaacagaaacgaatcaccagttctatcccatccgctgctaccgtacgggacctctccagggaatgagctcttaactaccgtttggatgcaacagctcccgcactcacctcgtcattcgcgtcccccccatccgtcaacgagtctaaagctcgttactactcccatattgatttgcggtttttatgagtgcgcagaggttttcataaggtacatcctcctggatctcctgggacggccctgtaatataccctccattttctttcatggcttctatgacttttctggcctccgcttccacttcctccgcagtcccataaggcagcactctttgtgtgctgatccccccatagaatgcgatgcgctttccataatccttttttagccggtagatatccatgcactcgggctggatgggattcaggcactctactcccatctctgcaaggtcatccataatccgtatgatatttccacatgaatgtacaaaaacatttttcttgtatttttttattaacttatactcttggatctcgccttctttgataagggtgcggaagcactcgggggacatgatcaggtcattttgtgttccccagtctgatcctagaagcacgccgtctatatatgggcatgtcaagatgttttcgagcataacaaggttttttctgatgatgagctccagcagtttacggcaccactctggggcagccgccaggtcgcacagaaagttttctatgccccggctgaaataggccttttcccagtggcttccccaaatggtaaccaaaatgtatgcatcgtaattctttttcagatattccaccttttcaaaaaatgcttcatagcttccttttccgattgtatcaggtaatccctcgggagtgtcctcttctttaaactctgccggaaggttaatccagtcccaccaaggtgcttcagcataaagaataaaattaccaattgcaagggatgcagcttccttttggcttagcttaccctgccgatagtccgtctgtattttttcatttccatagtcgtcaatcagacggtctccgtatagcccatacccctcttctgtcagatatatagaatatggcactattccgggatcttcaaaattcagagatttctttacaatctgcgttcggttcattacatcctcctatcgtttatactcttgctcctaagataatcttacttccacaatctggtgtccgttcacctccgggacatggaatatcactctttccttttcagatcggtactcaagcggaacattctgcggctggcagtatactcctttcacttctcccggtacttctacactgcactcaatattataaacaggcagcacatcctcaatgacgtcaatagattcgcagcgcctttcaggaatgtaatgcagcagatgcacaatccttctgttttgggccggctggtcatttacagcggtaagcagtgcggaaggtccgttatgtgtgataatccgttcctgaagaagcagacataccgcatccttcaccatttttttgcaccagagaggtgcattgtattgatattgtatgaagacaggatgtgaaaaataaatgctgtttccgttttgtacgacagccggctgtgctatttctcccgagcagggcgactgcctgtgtgaacaaaagtaccggtaatctctgtcaaaaacagaggcatacgcatttacaagcacgtttgctccctcttttgcatccacgtcgacgcctctcgcatacatgacatgatagtcctttggcagatcctttccgatcacatcccccggaagaatatactggcagtaatctcctctgtcatagatctttccgactacatcttctccgtatacgtcaactggctgttcctctctctttgttacgccgatatccagtgcgaagctggcttcgtcgggagtgagtcccgatttacacgtaaatatagcctttcctccattttccatataaatggaaagtttatcggcaaacagcggatcaacagggatttggtccggaaggatcagcagcctgtattttgcgaagtcactctgcgtgtccaccacgtcaaattgaaatgcgcattcctgaagcatcctgactgctccctggagtgatttcggcagattgtcatttgaggcacccacaaattcctctgcggtaaatacgcctatttccactgcgggtttcacgtcatcgcaccaggcctctttttcttctacctgctcatacacttttcctataaggtcataaaccgcaggtgacagcctcccgtctggattgagctgatccccgattaggcactttgcccccattgccagcatatgaaaacattcaaattccagagctgcctggttcttgtaggaatgaaaatcaccccacatggtatggaatttgcctgtctgggcgagatattctttccccaggttcctggcatagcgcactgtggagggaaagtgaagatatccccagataccgctcgggagcgactccagctcgtaatgggtataggtatccccattgcgcctctgatccgtccccacatgtcctctgttgtaaaagatcgtggtattctcagatttgctgtggataaattctgtcatttctcgctgccattcgtcgattgttttcttataaaattccagcctgtccccgcggtccagaggattgtatccgttctgttccatcagctttctgcaggcaggacatgcacagggcacgggaaaaacaatgtccagaaacaatccgtcgattacctcaaatgtatccagaatctcttccacgtgctctttcaaaaattcccggtaaccggtattcaggcacagcgtctcgtaaaagcctgcctcaaacggctcctgcttcctgccggactcaccgattgactgcccgttctcatcgatacaaagccactccctgtgcctctgtgaggtgtagtagtcccactgcaccgttgtatagaccggagtacggattccaattttacggcaggcctcaatctgctccttaagaagatttttattcacaagatttggatgcacacgctccggattctttttggagtcataataaatcatgccgtgatggcatcttgcaaacagagtgaccgaatttacatgtgctttctttaatgtctgcgcaaattcttcggggtcaaatctctcccctatattttttatcgtctcatttgtgtgaaaatccagatgaatttcacgaaatggcagttttcccatatatacctccaatttataatgttagcagttcgggcatggctgaactgctgctgcccatgcgggggttccccccgccagactatccgcacttttccgggcgcgcctaacctttgaccgctcccgccgtcatacccgcaatgatattctcctggaagatgaagtaaatcagcatcgtaggaagaactcctatcataacggctgcacacatccccggaaaatttgaaaaccggtccccggcaaacatatttaatgccagcgaaactgttttgagttcatttttctttaataatatcagcgcaataatcatttcattccatgttccaataaaagacagcattcccatcgttgcaatcgcgggcctgctcagcggtaccacaattttagtaaacgttttgagcccattgcagccgtcaatcaggccggcctccatcagttctttgggcagatttttcataaacccgcagattacaaatatcatatatggcattcccgtagctatgtatacgcagatcaaaaacggaaggttgttgtatccgtccatgtactttgccatgattgagattggtataattaacacctgggcaggaatcagcatcccgattacaaacagtcccagaactttattggaacttttaaagcgaatctgtgtaatgacaaaggataccatacagctgatgaccagctggcacacgactgtagttatggtgataaagaagctgttaaaaatgctttttccaaaccccatatccgcaaacagccctgcataattttcaaagtgccaggtttccggaaggccgaacatatttgtatacatggaggtctgtgttttaaacgatgtcagaaaggtatagatcagcgggtagatcgtaataaccgcccaaattatcagtacaatataacagatcagttttccaatgctaaaaccacgcttaatcatccgaagcatctcctttctttccctggaaccccttgaaatacacaaaaacagatgcaattgcgccgaccagcatgacaaacagggccatcacgcttcccctgccgaaatcatttccccgaaaggaggtgatgtacatataccccataggaaccatattggcttctccaggtccgaatgttccgctggtgattacataaaagacatcgaaggctttcatggaattagacagaactagaattgtcgccaccgccagtatttctttcatcattgggattgtgattttaaagaccatattccagctgttggctccgtcaatcgcagccgcctcatacagttcacccggtatgccgatcagtccagcgagcaggattacaaagggcatccctacctgaagccatgtattaatcagcgtaatcacggtaaaacaaatgtccggatccgtcagccaggaccttgccagtgtccccagacccatgttgttcaaaagcatgttcagcatgccttcattggtagataaaatcatcttccacatgagggatacagcggttacagacaataccgccggcaggaaaaaggtcagcttgaagaatctcgagcccttcagttttaaagagacaagatatgccagtataaatccgattaccatttgggatacaacactgatcacaacaaaatatatcaaacgcccaaagctggtccagaacttcgggtccgtaaacacctttgcataattccgaagcccgataaatgagaattcactgcctccaattccgcgccacttaaaaaaagacaaaaacgctgtctcaaatacagggcttatcataaatataatataaaaagcgaatgccgggagcaaaaatgcaattgcgagctttttattctttttaaaatccagcaactgttacacctcctgtttttccggggcagggcatgcccggcgcccggaaggggcgctcttccccgcatgctctgtttgatccctcattctttactcgctgtacatttccacttccgcatcaagttcttttccggcctgttccggggttagctgcccgttcaccagtgcagaggccacgtctctgattttggttagcattgtggatactttgtcgtagttggtcacgtcggtcgttgctgcgtccgcgttattaatgacatcggcaaatttactattcagacggtttaccttttcaggatccgcctccacatctttattagctacaagcaccgcattactgttggcaagaaccgtctgtccctcaacaccgcaaagtgccttgcagagtttccaggatgcttcaatctgttcatccgaagcattggttgcaattcccagggcgatgtctccgcccccgaagttattcttcgcaaattcttcttttccttcaaatacaggcatctcaaagaagtcaatgtcatcaccgacctcagaatccgggcccgtatacgcctccgcatgagctgagattccaaagttcaaagccgctttccctgtctggagcatcgtcatttcgttcgaaaaatctacagatgcaggctccggcccaaaggcttccatatctaccagcttctgcagttcctcccatgcagccaccgcttcaggagaagaatatttcatgcttcgatcgccaagcgccttggccccttctactccgttcatcctatagaaaattgcagaatacaggtgttctacacgccatccgtcttttgcgcctaaagcccagggaatgacatccaccgcctttaatttttccacacaatccaaaagctcgtcccaggtagcgggaacctctttgattccggctttttcaaataaagctttattataatagaatccgcccgatacgctggagaacggtacgccccacatcccctctatgtcatcataccgcagattcagggcattcagggtaacatcagcaaactgtgccttaaactccggttctgcatccatcttctccgtcatatccaaaacttttccagactgcactgcctcatacatctcagcgccgccccagtgcataaacacattagcaagagtatcggaggcgatctcggataccagtttctcgtgatattgtgagctggactgtacctccagttccactttgatatccggattatccttctcaaactgttctacaagttccataaccggtttgtatcccggttccgcttcgcctaaagttgaatagaatctgatcgttacaggttctttatcagaaccggaatcctcctgcttgctgctgcatcctgccgcaagtgatgtaaccattgccgccgcaagccctacacttattactttctttaatgctctcattttctacctcctgtaaattataaattttctttttctaaataaagtatacggaaaaataagggaaaggaaaagaaactgaattcttattttctatggcaaaattcttttcctatatccaaagcaattgcatatttccggtaaatgttataacctaaatttaatttaaataggaagggggattttcatgttccgctcattcaaaaaacagctgaccgcttttaccataggctttgtactggctatagccgttattatggcgctgctctgctaccggtttatctatcagaatattatttctgtctccgtacagtacaataatcagatcgcgaaccaactgtgcaaaaatattgaactattcatggaggggattgacgaacagatcgagtctgtggcctattcttccgagatccgttttttcggaagccattttattactcccggcatttcctcttcccgcagcgatgtaaaaaaggtactgtggagtgcagccacccagcagaatggtttcgatgatatttctattatatataacggcaaaaaaatgatctccttgtttaacatgtatgatgaaaaaagcctgcttgaactctgcgattattatgacaagagcgaggtttatcttaatgcccgattcgtccctctgattcacagcaataacaatgggcattactcgctgtcctgtattaagtccgtatcgaattcctccgttacaagcggatattacgtgattggcagcattatcatagatgatatttttgagatgctcaataacgtcgatctgggggacggcagcggcgcctgcctcgtagatgccaatggctctgtacaatattccacgctcgtggagggtacctttacccaggatatgacgaatctgatacagacaactaatttcaagaaagactccggttttactgcacgcctgaaccgtgaaaattatattatatcggtctatccgctgaatcattccgacctgagtacggttgtctatatccctttgtccaacgtcacgaaggcagccgcgcctctgctctatacaatgctgaccatcatttttcttttcttaatcgtcagtattgtaatcagtgtcaagctgtccaaccgcctgacttaccctgtcaccgccctggccgttcatgtgcggaactgggatggctgcagcaatcagttcccaaaggtaaagggaacggaagaaactgatattctttatcattcattccagaagatgaccgaacatatccaactgctgatggagaaaaatgcgcaggaaaaccggcagaagagaaaggccgaactgctggccctgcaggcacagattaacccccattttctttataatacgctggattccatcaatgcccttgcaatattgaatgacgatcaggatatctccaatatgacaaccttcctcgcccatctgctgcggctttccatcgggcagccggatgaatttgtaacaattgatgatgagatcaagcatataaaggcctatctcaccatccagaaaatccgatacaatgataaatttgatgtggagtttcatgtagacagcagtatcggccagtttccaattatcaggctaatcctgcagccactgatagaaaactgcatttatcatggatttgagactaaggagggaaaagggcatatcataataagtgcaggggaaagcgccggccagatcgtcattcagatcatggacgacggtttgggtacagatcccgtgacggaaaaagaaatccagaataatctggcttccgtaaaaaaacccgggaatggttgttctgtcggaatctacaatgttaacgaacgcctgcggctgtactatggcgataaatcctcgctcactttccacagtgtccaaaataaagaaaccgtagtcacaatccgtctgccaaaagaaaaaggagaattgtaatgtttaaaatagtgattgccgaagatgaatttctgctccagaaggcccttcaaaaaataattatcggacaaacccgctatgagatcagctttacggcctctaacggcaaggccgcattagattacctgcttttgcacagagccgatattctaattacggatatccgcatgcctgtgatggacggccttgaacttgtcacaaagatcaaggattccggtattagaataaaaaccattgtaatcagcggatacaatgattttgagtacgctaagcatatgctgaaacacggcgctttttcctacctgctgaagcctcttgttacggaagagcttctctcaactttggctgaggccacccgtaccatccaggaagaagagagtaagcgcaatatcttgaagtctcacaagtttaatgcgcttcagcagaatggctatgtacattttacggacgagctcccctctgttttactgaattcccacaggctttttgcctgttgtacggatttcaaaagttcaccggccaaaaccgacatagcggattttcagtttgacctggagacccgcttctacccctgctgctgtttcatgctggacaactatctatatctggttaccagtctggaggacccggaacgagaccggatagaaattgtgaccgaactgcagtcttattttactgacagaaatatttcggttaagattggaatcgggctcgctgttttgagcatgatggaggtataccagtctatgaaacaggcccgccatgccctgcgtttctataaagcgcttcccttcgatgagttcgtggactatgaaaggatccccttactggaagttcctgcaatcccctacccgctcaccgaagaaaagaacctgctggaaagtgtctactctcacagccctgaccggatccagcagcacatcacacagttttatacctatctctccggccaggataaagatgtcatctaccagacgctggcggagctggcagtaagctgcaaacgcgaattttccggctatcagctggaatactgcgattgggatgagattcatttccaaatccagcaccggcagaaatggagcggcatcctatacgggataagaaaaatcctcctgtacatacagctgcagctgacggagagcagaagactggcaaactgttccaccgctatgacagcccggaaatacatcgaggatcacatgaaggaaccgctcacactcgatgaggttgcgaatgcctgcttcctgagcaaaagccacttctgcaagatattcaaggaggagaccggccgaacattcaaagcttatttgaacgacatacggatcgaacgcgcaaaagacctgttgaaaaacagtactctgaaaaactacgagatcgcacaggaaataggcattgaagacgccagttattttaatgaactcttcaagaaaataacgggaatgacgcctgtcgaattccgtgcgctttaaactactcagcaggccagtacttgaaaggagcggcccctggcagcgtatgctcacacttacagtaacagtaaggtatttagtgtaacttaataccaggaaccgctcctcctttaaagcatccttctgctgcggtattctctgggaggcattttttcgtatttgcggaaaaacctggaaaaataaaaagcatcctcaaagcctaattccacggcgatctcggatatcctcatatccgttgctgccagcagccttttggccctgttcattaacagcgtttccatatactccttgagtccgatccccgtatccctcttaaaattcctggagacagcgtaatacgattcccctaaagctgctgcgacttcacttacctttaatgccccgctcagatggttttccacataacttatggctctctgttgtttttcatacccgctgtaattttcctccatgccttcccgcctggctatttccaaaaagcgtgatatgaccgcgagcagcagggactttgcagctatgactttatccattgttttctgtttcagattctccagcagcagctccatttcttttggtatctggggcagttccattgccaccatacaccgggaaaacaggtcgatccccggtatcagctgtatctggaaatgtatataaagctttttcataaggccctccgctttataatcgtaggtagctcctgccggtatcaaatataggtgtccttctttcaggtccatctgctgcatgtcgttgtgtatatggccttccccctccagtataaagtataatctgttaaacggggatactacctgtttatagtcccactcctcccccgccgtaagaagcccgctctccacaatttcgaatttaatctcatttatcttttcttccagcattgcaaatttttgattttccatagcaaaaaactccatttatttttatattaattgcatgtacattttccctatattttctataattatagtatacaaaataataagcaggaaggaaagtgataattaatatgtcttatgaaaatagcctcagcgccctaaatctcgagatgccgccaaaaattccccgcacagagtattccgcacacttccactgggatcttgtgcaaaaagttacaggaattgaagtctcttcatacagttccgggcagacccgcatacatgcctcagaagaattcattaaagcatgggactacggctttttctggaacattattccttttgatgaacaattcggcgagaatcacacaaaaatgggacatgcgtcctatcagcagaatagcacggattattcagacgatgtccgtgtattcatcgaggagccggaagatgttttcgatttggattttttcgagacctatggggaaaaggataaaagcaggctgattacagattttaatcaggactaccagaaaatgatccgggaacatccggataccgtaaacatgaccggaatttacacaacctgtatgtccggggccatagagatcctcggctgggatatgctgcttctggcggcaggtgtggacagcaggctgttcggagaatttatgaaccgttatacagagtggaatctgcagtattttgaagcattagccgaatgcgaatctcctgttgtcatggtacacgatgatattgtatggacaagcggagcttttctggcgcccgaattctacaaaacctttatttttcctaatttaaaaaagcttctggcgcctttgcaggaaaaaggtaaaaagatactttttacatcggacggtaattttacacaatttgtggatgatatcgcagcttgcagtgtcaatggttttgttatggagccatgtaccgatatgtcttatatctgcgaaaaatacggaagtacacacgtcattgtaggaaatgccgacacccggatcctgttgtgcggggataaagatgatatagaaaatgaagtaaaaaggtgtatcgctctcggaagagactgccccggatattttatggccgtaggcaaccacatcccgcccaatacacctgttgataattgtttatattacaatgatttttacgaaaaatacagccggagatagcggcatgtttatgtaccgttgaaatctaaatatcacaaaaagcgggctgaacctgcccgctttctccaatcttctttaacgctttacgctatttaccctgcccgtagtatgcccctggcccatgttttctcaaataatgtttatcctgcagtacctgcggagcagaagtcacttctctgttcagctgttccgtacggaaagccatctttgccacttcttccagaacaaccgcattgtgcacagcctcagcagcatctttcccccaggtaaacggtccgtggttggagcacagaaccccaggcacactggcaggatctttttctttaaatgtttcgataatcacaagccccgtattcttttcgtactccccgttgatctcttccgcggtcagggatctcgcgcagggaatctctccgtaataatagtccgcatgtgtggtcccatagcagggaacgcttctgcaggcctgcgcccaggatgttgcccaggaagaatgggtatgtacgattccgcctacccccggaaatgccctgtacagttccaggtgggtcggcgtgtctgaagaaggattatatctgccttctattttgtttccttccagatccatcacaaccatatcgtccggcatcagcgtctcataatccacaccgctgggcttaataacaaaaaaaccggactctctgtctatcccgctgacattgccccatgtataggtcacaaggccgcggcgcggcagttccatgtttgcttcatataccttctgctttaactcttctaacatctctttctcctcttcctttattcctggaaatccacaggtaccccatcttttgttacctgcactacgtttacttcatactcccggaaaccatcgacaatctcttggggcgctttttcatctgtaattacattcagaatagagtccgtagggcagctcacaaagctgctgtttctacccagcttggtgtggtcggctaggatgtaggaggtgtctgtaacccgctgcagcatcagctggttaatatttacctcgttcagtatctccgtagtcatcccgctttccaggctcagaccggaacatcctataaagctcttcttcgcagttactttactgatattgttggaggcaaattcgcccaccatggcctctttgatctcgcgcagctcccctccgcttagtatcactgataccttggaagaatgctccgtatagatggctttcccattgtttgtgatcacaatcactcttttatccttaatgtattttatcatctgcagcgccgtcgcgctggtatttataaatatagtatctccgtcctctaccagagatgccgcatactgggcgatcctcttcctgtaaagcttgatctcatcctcttctgtattaatctcggttacgcggtcggtcacggtagccccgccgtaaaaacgttccagctttttctggtcctcaagatactgaagatcccttcggatggtaaggggagatacctgcagctcttctgccagttcctgcacttttacaaagccgttgttcttcagcgactgcagcactttatttcttctgttatcaactaatgctctgcttcttttcatatcttttcctctttccaccactttgacaggctttactttctaaagaatatatgattagatcatgttattaagacaattatatgaatgtttttctgaatcgtcaagtagtcttgataattgttggacgggagggggggcgcgaaatgaagagacagacgcaagcctcccaagtgcatatgtgccgctttagcaccctgaaacggcacatatgcacttgggaggcttgcgtctgtcccttcatttcgctgggtgcatccaatcggtagaaaaacttgtcaacccggggaggctccgaagcgggtcagcgtatgaattcgcttggcggaacatatacccttacgatgtctcccggctatcactttatggtgcgccaaccttgaacctgtctcaaaagctaccgtacttttcaaagcactccagcgcatagagcatggattccttggttgtgccaatggcatccagataaccatattccactcctataagaccgcctttgggcgtagcccacttctctaccagttcttttgcttcctgttcgatcagttccttgtcgcctgtcgggagcgttgcctgaatgtcgatggctgcttcgaagcagatgcggccctgtgcgatctttgatacttcgtctataccgaccagtcttggctgatgaatgttgattatgtctacccccagttcgatcaggtcctccaggatatcattgatcttaccatcggtatggaaacggatatccatgccgcactcatgcgctttatcaaatatccttttatactgcggtttgaatatttctctgaatatgtccggggatatcatcagattgttctgtgtcccccagtcatcggttgtatcataacagtgaattctgcctttgcccagtctgtaggcttcttcgataatgccaatctgataatccgcaagcctttcagccataacctcaatctcttcgggctccacaagacagtccattaatgtattttcaaaacctcttaagaaatgcatgcgttcaaagatacactgcgggctgttcagctgcacgtagaggccttttttctccgcctcatcaagtgcctcctgaagtccctcaaaacgcccttccgccttaggatccgggaatacataatcatccatatcgtcccattcctctatcggaatgttcgttacctggcccatatcagagccgctggcatcatcgctttcccacatacatccccattcatcatattccccgttcttagggcgcacctttttggaaactgtatagtccgcgccctccggccatgtgctttttggcggcaggacgaaaatacggcatacgtcccctttaccggcgatccggtcaaagcggagtccaattcgatccggccccgtaaatttcacgtttcctttgataatctcataaccagtcattttcatcctcctaaaaatctaaacagttaacgagtgcctcccggcgtaaatataccggtaggcactaagccttactttatttcatttgggaaatgttcttttactgcggcgagaagcgtctctgtcacagcagccgtatcaatcaggttctttgtctctgcaatgacagcattgcttggcggaagcatccccgcccactcaggactggtcagaaccagatccgttgttgtgataaaagacagcgcctcaccaaatgaacatgattccacagcggcgtcaatattgtgctcatcacaaattttctttacactgatctttaaaatcgtgctggttcccataccatttccgcacacacataaaatattaagcatcttttttacctcctgttttaattgttcagatccatgaacagttaccttgttttttcagtgaattacctaacctgctatcggaattcccaacagacttccaattcctttgaagatcgcgataattactacccatattgtcgcataatctgcgcttccctgccaccatgttatttccatcatcttaacagcaagggcggaaccaagtatctgaaccagaccatttgccgtacagatcagggctgctgccttccagccgccaaacttgtttgcaaagattgcgatggtcgcattgtcgaagaatagcggtataaagccgggtaccaggaagatcggggacttgaataccaacagtccgacaagaccgatgatctgtcccagagctccgaagagcagaccaagtactactgatttaggagcgaatgcaaagatcgctgcacagtcaacacctgctaccgcgcccggaagcaatttctctgagatacccttgaaggacatcatcagctcacccacgaacatacgcacaccactcagcaatacgacgatgttggctgtcagtgtgatggcaatccagataagaaatacaacgttgtttgtcaggcccgcctgattcagcccttctgctccccggagccagtcgatctgctcttttcctaccacaagcataataattgcagtggaaatgaacataacaagggccgttgcaataatgttatcctgaaggaaattcagtgattccggtaatttctttttctcaatatcatctttttccgggttgccgatctttggagccactttgtaggcaatatagtcaacaaccatctgctgatgggctaccgtaaaatctgcgcctgtgattttctttgtaggctcgatcagcaatgtggaacaaataccccagtaaagagcggtaactacggctgctatcaggactgtcggcagcattccgagtcccaggaatctccagacaatatatgtactgatacctgcctgaacgatcatagcgttacctgtcaggtaaacggcacggattcttgtaaactttctcagcgccacaagaaccagattcaggataaatgctacaagcagcgtgtaaatcccccatgcagcccctgttccctctccgagaatcgcatctatcttctcgtaaccggcagtcatggtcgggtatgtattaagtcctgccccctggatacctgttgcgttctgaagagccgtcagaagttttccgaagttcgcaatcagggcgccggatcccatccccataacaataataccgatggatgcttttgctgcacccgcaattgccttggacaccttctgtttcatcgcaatataaccgataaatacgatgattgccatcaacagaaaaggctgtccgaagatttgttttaagagtaaatcaagaattgagtttaacattattcctctccttcctttgtaacaagattttcctatctctttgtgcaaaatgcattcttgatactttgtattatagtgttcgttatgataattgtcaatcttattatatgattatttatcgttttatataaaccttttttttctttaaataagttttacgcctcattaatcaccatttcattgctatatattcgttttatgttcgttataattcatataatcgctgtttggtcacaattcccaactctttttccaggtatctcgccacaccatcgtcattattgctgaatgtcacactgctggccgcgtctttcagtgcctttacgccgttttccatgcaaattctataatccgcgcatgcaaacatactcagatcgttctcataatccccgaatacacagacgttttctttaccgatcttcttctcctgcataattgtctcaagagcagtttttttggagacctggctctgaaatgcacctaaaaggccataccccgttggttcatggtgcacgtttgccagactgtcaacgaaacttatgtacgcttccattgctgtttcgttttcctcgtaggccacgatttttgcagcagtcttgtaccccagcacagagccgctccggagaaactccctgaccttgagttttaccgggcagcctgctttctgagacagcgcctcgtaatcccggatcctctttttcaatttttcgcttccctcagaaaaatacatttgttctgcagaatacatcataaatgtcatctgctgttcattcagataagccagaagactggcggtatcctcctctgccagaaaattacagcagatcacccgcttaccgcttcgcacaagtgcgccattatcagacaacatgtattcacagccgccaagctgtttttcatagatggacatcatctgttcatcccgtccggaggcaaggcagacagcaatccccatctccctgacttttttcatcacagataccgtatagggggtgatcattttctcgtcatttaaaagtgtcccgtccagatcgcagacgacaagcttaatttcgctcatagttctctccttcttttatacagcgtatttgttcctgcagctcccggcatataagttcaaataattccctgcctttttccgcagtcgctgcggatgcatctccgaaggccccgctctctataaaagttctccatggcaacggctttttaccataaagaagcggaaccggcgggaattctgcggtcgcagctttcatatccaccagttcctccttaacatagagcatcagagaagtctccagctctcccgcatgccatacacttccgttccacagaggcgtagtcagaatatgtcctgctttcttttcaattccggcagccttcatatgatacacatgatccccggtcccgcgatcggccaaagttcgaagaatctcttcaatgaccttatgatttccattatggaaagaatacaaaataatccgcctggggctggcacgcatcacactttccactgcctgcaggcagtaattttcaagacatgccggactgatggatatagtgctctcaaactccctggcggaccatacctgtccataggttatacatggataataatacatgtcctctctttcacagatctcttgtgcaaatgcatgcgccagtattgtatccgtcccgagaggcaggtggaggccatgctcctccaccgaaccaagggttaacagaacaccttcgctctcccgtatattcctgctcgcagttgtccagttctgataaaaaagatttctcatagctcagaatactttgcatccagtgcaagaagttcttcttcatccttaacattcatcaatgcatccatgatatcggctgtcaacagcatattggccagtttttccatgtttttcatatgttcgtcgtggtctttggaagccagaacaaagaacagcttggcgtctttttccggattaccttcttcaaaatgtacaggttcctccagtttcatgaatgatactgccgtgtcattcactcccacagcgccttcctgcgaatgcggcattgcgatattaggtgcaaacactatgtaagggccatattttttcacgcagccgattacagcatcaatatatgcctgctcgatagagccatcgtccagaagaggctggcaggatgccgctaccgcttcttcccatgtatcaaatcctttatgaaagcaaactcgttttttctccactaattctcttaataacatttccgcattctcctttttcccgaatatttttttacagaatggaacggtaaggcacgtttggctcatctgtaaagcagtcttcaaatcctcttctataatggaactgttttttatctttgtccagaggccagatatattttccacccacatcccagatgaatggtgtgaactgatactgtaacacatcttttttaaagttgtaaagcatcaaaatctccgccgggtctgccttaaagttcgtccatacatcataatggaacggaatcacgaccttacactgcagagcctctgccattcgaaggatatccacagatgtcatcttatcctgatttccggccgggttttcaccataagaaccaaaagcaatgtctatatcatagtctttgccatgttttgcataatatgtagagtaatgagagtccccgctgtgataaacggttccagccggtgttttgatcaggtaattgaccgctttttcatccatatcgttggggcaggtatttcgaatatcctcatccgcggttacaagacaggttctgtcaaaggaatccagtaccacaatctcgcagtcttttacccgaatcacatctcccggttttacaattctgcatctttcttccggaactccatagctgagccacttttcaacgctcttaaggggcccgataaatgggacatcaggctcacagttctgcataactgctgccgcaaagaacgggtcaatgtggtcattgtggtagtgggtggacagtaccgcatccacagctgtaacggcaaacggatcgtaaacaatcggcgccgcacgcaggtttggctgcgtcatccttccccctgtcatattgcgcatctgatggaacggagccatctcctttgtctttttgcttcttttaccattgccgaaccacaggtcgattgcaatgttcgtactgttctcggatttgatccagagcccggtgcatccaatccaccacatggcgaatgttcccggggcaactacttcctcatcaatttcctcgttcagccaggttccccattccggaaatgctccgagtacccatttctctcttgtaagttcattcactttgctcattttgcttcctcctgccttaaatgattgttatttttcattaaaactatcgtttattatcttttcacgcttattttatcatttattatgaatgttttcaatgcatttatatgattattttgtttttatatgaatatttcacgtatcacttgactaatcataaatctcatgctatcctataggtgtattttcatcggagttagatttcacatatttttgtaagtcattatgttccattgataatgccttacaaaaatatgtgattttttattttctgagatttacaaatattatatttaggaggtacctattatgaataacggtacagtaaaatggtttaacgcacaaaaaggatttggatttatcacaaacgatgctaacggagaagacgtattcgtacacttttcaggaatcgcttccgatggttacaaatctctggaagaaggacagaaagtatcatttgacatcacagaaggaaaccgcggacctcaggctgttaacgtagttggagcataatccggttttagtgattcgtcagatttgaattctatgcaaacctaagtcaaataccccgcaggcgtctgcggggtatttgttttttcttgtattgtccgtggatataataactgacattcatcagataatccggatttgtaatctatctgaaagaggtgctgtctattgacggtttaagaccagagaatattatgttacaaactgttaccaacttaaaatcaagcatgctttaattagaatctacgttggttctttgcaaaataggtcgaaaaacggtcgatatatagtactgaaagacatcaatatgtactatattatagatgttgccaacatcgcaaatgtttgtaattacggtattctctacgcatgtagtactgagaattggaaaactttttattaagcattgctgcataagccttccccgacgcttaacgttcggcagaactcagatcccatcagccgcagccgggcagctatggatacggtcttcacctggcctggcagcaattcgaaataattgtcggaacagtcattgaccccctctatatatacaccatggaggaacacgtcacttgtgatggtcagatgcaggcctccgtcctgctcgacacacagcactcttggctcaccgtccggcatatccaggcaccttgtctcacaagcaaacaaacgttcgggggctatctccatactttccggtatgacagcgactacgccgcgttcaaggtcaccttccggaaagtcagtctccaggatatggctgcgactatatggcagcaatgtcagcggaacgattctagtgtcccgtactcttccatccagggagatataacctacctcagccatcgtgtcgacctgatccggggtgtcattacatccggtgacgacgagcttaccgtccacctgacgcaagatcagcttcctgtgagagaaagcccgcttcacaccgtagtatgaaggctttttctgcagacaatagtccacgacggaccagcccacctctccccatgagtcattaaacatccagaacaatgcgccggagcaacgcggcttgaagcggagcgcctcaagcgaatatccatacataagggactggaccatgccagaatacagaatgtagccatccagatccagcgactggggattgtccatataatgcttgacgataccgccatacacggtgcctttttcgaagtcgttgttatgatgatcccagatcccggacaagcggtctacaggctgcccgtcgaaatacgactctatagccacacgcgagggtgcgccaaaatacccgtattccgacacaaaagcatggttaatcaggtcataggccatcggatcgatgcgtttctccatatcaggatgcatcgagcaattccaatgatgggtgtctcctacctgctctgagtccggaaattcgccgccgaacggagagctgttccaataaggtatcctagaacagttggcatgcacagccttcttagagacatagttggatatcctgagcccgaactgccggtcgggattctttttcagcagcgagatataccagaaatagcggtgcaactcgttatcaccgcaccacaggcacatagacggatggttcctaaggcgcctggtctgatagtcagcctcgttttccatctctcggacgaaatccgggtcatgatccgggaatgcaccgcatgcaagcataaagtcgtgccagatcagaatgccgtagcggtcgcacaatcgataaaatatttccctctcataaatgccgccgccccagatccgcagcatgttgaagttggcatcatgggccgcgcggatcagctcctcatactttgcatcgcagacgcgggcatagatcgggtcattgggtacccagttgctccctttgcagaatatcttaacgccgttgaccacaatgccaaatcctcttcggccgtcctcctgccgggagatatccagcctgatcgtgcgtatgccatactgaaacttaggataagcggtcttagagccgcagcattccaggcacacctccacgtcatacagcggttgcgcgccgcttcctgcaggccaccagagctttgcgtcctgaacatccacgtccaggtcgatccagttgataccggcggtcagcagaatgtcatccacgcgggcataggcgcagagtacgccatccattctgagcatgatatcaagatccgcgtcggcacatcctataggattgaaatactcgacctccgccctcagacgcagatgggcatcctttccggcttccagcgtctccaagtcaacagagcgtatttcagcgactgaaaggcagcggacatatgctccgcccgtgatgccgatgctaaatgccttgggcaggaagtcccagccggcattgtactggggccggcgcagccatgtgcggcgatggtccccgcgttccgggtgccccgcatccttttcatgacaaatgctccattcgagttccgccaactgctcctcggttaccttttccagacctgttgtcagccgtatgcataaaacgtttttgcccggtcgcagatagcactttatgtcaaaagtgaacgggtagtgcgcacttttgtgggtgcctatgtgactcccgttcaggaagatctccgcccatgtatccaaagactccagtgtcagttccaccggaccatcgcctatatccagctcggagatatcaaattcccggacgaaccaccaagagcggtttgaaatccactcacattcccgcgaatagtctgccaggaccggatccttgataactccgctctcgatcagcggcatcctgacatcgcatgggagtgcacagtccatccacccatcctcaaacgccataacgcgtccgatatcgctcacgccccagcggagaggcgcctcgtgcagtttccagccggtgtgcaaagccaactctttcatataaaaccctccttctctattaagtactaatcaattatttctatcatacagcgataattgtcgcactgacttcttcaagaccctcagtcttcgctgatatttttatgattccggcttttccggtactcctggctatagccagcgccctgccgtgccatgatgtatatcttccgctgaaaaaatcttcttctgtaacgggattggcgcttcctacagccagaagttctccttcaccttccacgctgacgtgaacagctttatcttcatacatattcagtatcccttcgcaatcctgcaactctatccaaacatacgatatattatccacatccgcatgtatcttctcctcctccggacatataactatcctacttacctgaccggcgctttgaagctcacatcgcgctatttcttttccttcctcatcaaaactgactgcttccaaactgcctgcactgtatggaactgtgaaatcacacctataatcgataagaggtttccttgcaatcagatgtccatccttaaacagctcaacttcgctgccttgactgtacacctcaatctgcgcatctgaaccctcatatccgggccacgtccaactggcaacagcatctgactgacgccaatttccaagagtaaaagcctcccctgagtgttccagcggcctcaccgcaatgtacggtttttgatactctccccagataatggcagaataatatgcttgtgtctctggagtcccatttagatcaaaagaaccacaggccgctgtaagacacggatatggctttgaaaacggtgccttatctgttccgtatgtcggaagcccgacacctgtctctccgagataatcccatgccgtccacatgaaatcaccgatgacataggggtggtgcatgacagccttccagttatctgccatacgctgcgggaacgtctcggagctaaggataaccctctcctttacaagctcatgcgttccctcgtagaggttatgcccgtagttgtatccgactatgtcaacattctttacacattcacctatcaacgcctcaaggctttccggagtgatagatgccattatcttgggaagcagtgcgacgatatcgtttacctcctgacttcctacagccttatcgccttcagccttctgcgcgataatctcctcctcgccgctcgccttgcgttctttagcctcatttgcggctttctcgacctccatcttcttcttagcctgcatattggcgagcatggaaagcatactgtttatcgctatagtagtgggtcttgtatcatccagctcatgaaaagcatcgctaagcattttgcttatcactgcaccatgaggaaagccggtatcggttatctcatttccgatgcagtacattatgacgcagggatggttgtaatcctttgataccaaggcctctacatccctccgccattcagcgtcaaaatgatttgcataatcgtgagctgactgcggcaccttccactggtcaaagctttcatcaagcacatacattccgagttcatcacagatatcaaggaaattcttccctgctgggttatgggaatagcggatcgcgttgaagccgaaatccttaagcctctgcaccctcctgcgctccgccttatcataggttcttgcacctaaaagtccgttatcatggtggatgcagccgccctttagcttaaccgtccttccgttgaccataaaaccgtcgacagcattccacgagagcatacggaccccaaaccgggtataggtttcatctacggtaatgccatttctttttaacattgtatggagcatgtacaggctcggatgctccgcatcccaaagcttcgcgtcaggtatctctatctttgcgcaggctccgcctgcctcacagagcttctcatcccccaatattacctcatggactatttcagcatcctcaagctcatacgcatcgacgcagatgctcacaacggcgggtgatacagacattgtggttatcttcactccctccggctttatgccgttcttagctcctacccaaagattcaccgggcggtatatgccgctgcctgaataccagcgcgaattaggcgtctgcgaattgtccgctatgacaagaagctcattttctttgcctgtctgtatccttccggtcagatcgacataaaaatttgtatatccgtagatgtgcccgcctatttcctcgccgttaaacaataccttggaattcatgtacacaccctcgaattccagcatgaccctcttgtccgcgaaagactcatcgccgtagatacttgtagaataaaagtatttcccgccaggaaaatatccggttgcgttcccgttttcaagagctgcgtctctgttctcatagatcatggcatcatgaggcagatatatctcctgcttgtcatattcgcagccgtccttccaaaacagccatttttgtcttaatcttttgcttgtcattttgccctccttaatttcacaaaaagacgctacatctcatcttaatagctttcatcttgatagcttgccctgaataaattcggtataggcagattcggcaaaccatcttaatcaaatttccgtcccactatctgcaaggatttatcagtgtactccataagctcaatacgattgccgtccgggtccgcgaaccagcattgataggtgaagtcagggccaagggtgatatttgaggtaggcataatacctttattcttcaaatcctctacggcctcttttatattatcaacctgaagactcaaatgtgaatatccgactctttctttaccgagttccctaagcggctccagcataacgaaatttcccattggatagaaaaactccaataactgtcccggaactatttccagatacaccacccatggcatatctcttattgctgaaaactttctgatcataccgtcaataatttctccggttttttctcctaatgtctttgctgcaacatacaattccctgttttcagaaatagttttttcatagtctgcataagtcagcagcgcttttttcttgaaaccaaaaccatcacaataaaatttcaaggtcttatccatatccgtagggttaaatgcaagatgagagatagactccactttccaattacgattcgttgtttgcatactttataaacctccttaaaaattacctgtcttaaattgttgatcgaagggtatatacctgaccgcattcactgctcttgcggaatccctcgattatctccactacatgagcggccctctcaccgcacgcagcaggccgccgtccatgcatgattgcatcagccatctccgatacaccgattccccgctgatcgtcaaccggaccgggaagcagttcgaccggctgcggaacagagccgaaaagctgttctattaccttcttgttctcttctaacgctaaccatttaggtgtcaagccttggggattcccaaacatcagacgctctgccccgtcaacatttttctgcagcctaacctcaccgttaaaatgatccatattcgggagatacaaaacgccctcggtcccatatatgatgaagtggtgctgttccggcacgatggaatctccatccatcatcatagaaccaatcaatccgttttcgaactgtagtatcgctgccccgacattttctgttttcacctcgaattcctctccggtaacggtgctcttcctattcgggcggttgatcttctgcatgcaggatacccttgcaacaggaccaaacagatcaagcagggcatttaaataataaggcgaaaagtcaccaagaatgtcccctccgggccccaataaaaagcgcatgtgcccatacaacatatttaaatttcgttctattgttacagtaaccccgctcacctctccgatcacaccttttgcaatcagattctttgctgtctgtaacggtgtgcccaaaaatgtatcaggagaagcacctatctttacattcttttcatcagcgatacacaaaagctcctttgcttcttcatgcgttattgtaaaggctttttccgtataggcatgctttccggcaagcacgatccgttttatgagctcatagtgcgcatccgcaggcgtgagcacaaccactaatcctatgctttcatccgctaatatctcttcaaacgagcaggctacaacaccatatttttcaccctgtcttttggcggactccccatgcttcgaacagcatttgaccaattccagattgtcatacctgttcttgatatttgaataataaatatcactgatcttacctgcgccgactatggccaccctcattttattaatactatccatttcgctcctccgataaactcataaatatttttttatattttccagtccccgccttaaatcctccagcaaatcattcggactggcatcctgatcaataacaataccggtatcaataagattcagccctttggcttctcttatgatttcctttagaggaatgatcccttctccgacagcggcaaagcggtccgccccagcttttttatcagcgttttcgacaaaatcctttaaatgaagaaccgaaattttactgccgtaatttcttatgatctccagagagtcttttcccgcgaactctatccagcctgcatccggttcaatcttcaagccggaaacttcacggatatagtactcaaaaaccgtgtcatctccgtcatccgccagctcattaaaatgattgtggaataaaaaatctatattgtcctccgctaattctgaaatagccattttaagatcgggaatatcgctacttgcatcggatatctttgatttctgaggactgtatgcgtaatagcaaagccccgtatttctgccaacctccctcattccggacagcgccttttccatgctgcatcccagcatgggagaaagcattacatgagctcctgttacatcaaagcccttattccttacctgttcgatcttttcccctgcctccttagaggaccagataccggcatcactgatccctagctttctaagatgttcccgcatccgctcctccggaatgctaagagcatcctcaaaaagcacacacggctcgataaagtcaaatcctattttcctgagcctttccagagtcccttcaaaatcagtttcaaacaagctgccaagcccatatgtatttacaccgactctcataacaaatcctccacatatttcctgcctcggataaggctttctttataatcatcgccattgtcgtaaacaaattcaaccgtaaggaagccatcgtatccatggcgcttaaagcagcccatcaaggctttgaaatcgaccattccggtgcctgttgcggctcccgccatcctgctgccatctgcgcaggtgtcggcaaacatttctttgtctgatgctacgcgcatatccttcagatggatgtgtgctgtccgatctgcaaatttttcatagtaatcagtcggatcctcctttacaagcagcatattcccgctgtcaaagacaagctccagctgcggtgcctttgagaatacatcctccaactcggcggcggtgcagaaatgaagtttaaggtcgggcgtatcctccacgacaggatgtattccgtattttactgcctgatctgctattggcgcaaatctggcggcaagatgctcccttatatcctctggcttctcattctcaatgcccttgtgggcctgaggaaccagcatcaataccccggtccccagctcttctgccatttccacggcctcgcagcctcttttatacagcgcatcattcatatccttgtccggattggcatattcatccatataaatgaagctggacacctcaatgccacgtttgtccaattcccgtcttacatagtccatcccgaaggctttgacctcctcgccccatacatccacagcgctgtatccgctttcctttaccagatccagcatctcctcgtatgtgtccttgaactcatccctatcgccggtaatgatatatttaaaatatgccggcaatatcatattgattgtcattaagctgatcttcataatgcatttacctcaaggtttaaatatttacattcttcaggagtaagatttagctcgtatgcgtttatattttcgcgcatccgctcgatgctcttagtactgacgatcgcaaaagcatttatatcctgacggaatatccatgccatcgctatctgcgctacatttacctgcttcctttcagccagctcttcacagcgccttaaccgttcaaaattctcctcacaggcatagcccttttttcctgcatcgtccaaaacattatcaatatcggacagatcgtcgctcttgagcctgccggagaaaaggccgcgggccaagctggaatatgctatcacgggcatctgagtatttcggtaccaatccctgtcgcccttgtgggagcttcctgttattgactcgcagccgcctccccaagggtcgccgatctgctccgcgagcccataattgggacttgagaccgcaaacggtatcagaccgtgcttatcggcatattcattggcctcggctatacgctcgtacctccagttcgatcctccgaatgccctgatctttcccttttcgtgcagttcatttaatacttcgactatctctcccgcaggtacggaagggtcgtctctatgaagcaggaagatatcgacataatccgtatgaagctgctgcagcgagcggttcagatcgctctttatttccctttcattcacccggctgcgtccgaagatgctcggatgcgcacacttcgtcaaaaggacgatcttttcacggttgtcacttttttcaatccatttccctaaggatgtctcggcgcccaaatagttatgggctgtatcaaaggctgtaattccggccccaagcatggaatctaaaagctcattctgctcacgccccatcataaacgaaccaaacgccgttccgaaaaagatacgggataccggtttttcaacaagagggagtcttgtataaaaatcatctttcatacttacacctatcctttatcttttattctttatcagaggcatatttaccttctttaaggtctgcttcgatcgctgaatacttcttgtcaaggtcatacctagacatacagaaaacacataatgcgctaattatcgcaggtatcacaatataaatgctgttgattgatgtgatagcactcttcgactgtaccgcaagactggcatcaaagtttcctaagctcaatattgccccaagcgtagccgtgccaagtccctgacctatcttaaacgcaaaggttatggcagcattgcccattccgaccgggttaaacccgttcttccacataccataggtaatggcatcctgaacgatactattcattgaagctcctccaaaaccgaatccaaagccttttaagagcattcccgcgatcaggacaggggtcgctgtagaaatgaggggaagtaaaaatcctatggcggatgtacccattccgatcatcaagcaattacgttttccgagtttaccgatcaaagctatccccaatacaagcgttggaatcattgaaagcgaatagactgccgataacagtgcctgaaggctcacgttccccaatacatactgcgtataatatactgtggcgcttcctgtggttcccataaggaacatgatcaatgtacctgtagcgcaggaaagaagccaatatttgtttgtaaaaagcgattttaatatcctgccgataccaaccgtatttccatgattgtcctttaccgtattatccacctgctcattatcacctttattgatactcacgcgctctcttgtcagagcaacacaaattcccgttgcaatcacatatatgatcatgtaaacgatgaccgctccgataaaacccttctgtgtatagagctcgccgccgccgatagctcccgatatcttcagaaagaagctattgacaaggatggtaaagagcacattggtaccaagagaattcagaccgccgttgataccgcgagatttctggttcatagtggcaagaccgcagagagatgaatatggcaccgcaagcgccgtatagcacactgtatttgccagattatacgttataaacatataaatgatctgcgcggtacggccccatgtggcaggcacgaaaaatgccagcaccgcacatatgaccgtaggagccatcatgcgcagcagccacggacgggcctttccgagcttgctttttgtatgatcgaccagatatcccattacaaggtctgaaattccatccaaaacctttgagattgcaattaccgtggccgccagacctgcgtttatccctgcaacattagtataataaaccagcaggaaggttccgaataatgcctgctgtacatttacgccgctgcccaaaaaatacccgaaatgctccgagaatcctagttttgcatctacactcatatcacgttgtttcttcatttccagctttctcctttcattattacactgtaaatttatattaattattatgtatctggcggttcggatgatccgccgccagccaattacggattatcaataaagcgttagttcaaatatttctaactcgttggcttcctcaaaggacaaccgcagctcatattttccggcatcagcgttcaattttcctccgctttgtaaaccgtccgcgatagtgatatcaccacagaaggcatcatccatatatactttgatccttccgctcccggcacaaaccatctcaatgcggttccatctttcatcgttctttatatagcggaaaactacctcatctcctgaacctatgtttgttatcacttcgggatacatttcgctcgcagccgcatccttatttaagccgatatatgcgctgccctttaacgcacatgcctgataacccattatcctttcgcccggagcaaacggctccccgactccttgggacgtcattttgacctccgggatactcccatccggcagtatcgttatcggttctatacaaagacgcctgttttcctttactcctctgctgcatctgtgataaaaaacataccattggccatttacgcactctatagagccgtggttgttccagcttgcaggatcgcagtcggcattatcaatgatgatccccctgtactcaaaaggcccaagaggggattttgatgtggaatatcccagcgccgtaggcttccctctctccatatccgcatatatgtaatagtaggtatcacctatcctacgcatggaggagccttcatggaaaaagtgttcctcttctcttacgagattatccactacagaatcctcgtcaaatgaaaccatatcgggatttaacttaactccgtgagatgcaagctgtccccaataaaagtatgcctgtccgtcatcatcgacaaaaactgccgggtctatccccccgcagggaagctgcttcggctccttaaagggcccctccggcctgtcagaaatcgctactccctcgctgtcatcagccatgcagaaatagagatagtaccttccgtttttttcaatgcagtcaggggcatataaaaacggcacttcatttgacttaaactgatcctccagcttcagatccccgcctcctttttcgcgggcaatttgtatcatcttcaaaacaaacggcgtaagatgctctagatcgacccccggatacttcggcgcgtccggattgccaaaccacgggatctcatttccgtttaatgactcatcatgtatcgtccagtgctccatatccggcgttgagacaacatgatacttctcactgcagaatgcgccgtctttatcatcatagcttccatacagataaagactgccatccggcataacatggccctcactgtccggaacatgatattgcagcggcaatatgggattccttttgtttacataagtctccatttaaacctcctatctctgcaaaaccatcacacaacaacttttgcattttttgcttttatcactacgattgactcgccgcagccctctgctttaaacctgaccttgatctctccggtcttgcccgtgctgcgcactgctgccatcacctcgccctcgtacgtttcccacacgttctcgccgtatcctcttgttgtctgcgggtttgcgcttccgtatccctgaagaactccctcgcctgtaacctcaacagccacctcttttacagcaaacaggttgggagcacccttgctatcctgcaagcggcatgtcacaaaagctatatcatgcccgtcggctgcaatctcataacggtctgaatcaacactaagcaaaacgtcactctctgctgtattaagtacatatctccccgtctgcgcaccgttgctatagcctatagccgcaagctctccgggctcatagcagacctcccataccgcagtaaaaccgttttttcttccggcaggctttttaccgaggcttctgccatttaggataagctcaacctccccgtcgcaggaatatacatcaacctccgtcttcatgccctccattcccggccatgtccagcttgatatgttatccttgggaatatactgattgaatccgtgctcctttccgtagcgatccaccttgactacggcgatatacggttctttcctgatgccatatacgatctccctaaggtagcttgtcggcctgcggcagccgataatattgatatcgccaaaataagctatccgatccgggaaatgcgaaccgaagctcttcgtaccgtcatagtggaacattcctgcgccggcctctcccagatagtcgtatccggtccatgtaaaatcgcccagcacatgatgattatcctcaacagccttccaaatgcggacaatatccgcgggaaagttttccgtaaacacgatgggcttatttggatgtatttccttctcaagctcggcgcgcgatgtaagatagttatatccgcagatatcaggcgcctgtccgggctcctccaaaacttcactcaaaacaggatgcgcattaaactcatcctgactgacaagcgggagcagcatgttcatggcgctcactgtatcctcggcggaggctgccgcactgccgatatccgggcccgtaatgccgtgctcctccataagcgcagccagaagcttcggcagtttccccgctgcggcaaccgcgttaaggccgctgcagcccgtagtggtaaatctcgtgttatctaattcatgaagcttgttacagaatgtgcggttattccttcccccgctttcacgccctatgtctaatatctcattgccggatgagtacattatcacgcacggatggttataatccttgcacaccatcctctccgattcttcctcccagcaccgatcgaacaccgttgaaaagtcgcaggtatttttctcctcaaaccacatatcagacagctcatccataacgtagataccgtattcatcacaggccgaaagcatttccctgcttaatggattatgggctgatcttatggcgttaaatcctgcctccttgatctcacgcgcccttttattttccgctgcttggaatgttgccgccccaagaatcccattgtcatggtggatacaggcacccctgagctttatctcccttccgttgacccgcataccgcgcccggcatcaacggtgatcatcctaaagcctgtcctgacctctgaacggtcgattgtttcatcctcctcgacaagatccgctccgaccgtatacaaaacagggctttcgtcatcccacagcttcgcgccccgtataaatatattctggcgcagggtctctgtttcgccgccgaatatcgtggcccttacactatcctccttgacagtaccctctgctcctgtgataacaatatgaagcttaatatgatggcttcttctgctcacgtttcggagctttgtctccacctccacgataataccgtcttcatcaatatgctttgttgtgacccgcacgccatcctctgctttatggacgggtcctcctgtgagcagctccacgctcctgtaaatcccggatccggtgtaccagcggctgttaggcattgctgtattgtttgcgactacctttatctcattactttctccgaatttaaggtatttatcgatatccacataaaattcgccgtatccgtggagattattgtatgcaaagcagccatttatcatcaccttggccgtttggtaaactccgccgaaaaataatttcacggacctatccgcccagtctgccggcacatctatattttttgtgtaggtgtactggcctccgggataaaatcccgtctgtgccccgttgcgcgtatccggcgtaggtgtctcatataccatcgcgtcataaggcagaacaacatcactcaccacctgagcctgccccgtaagttgctcaagaaggctacctttcataacactccagccgtcatttagcaaaactcgtttcatacaacaatcctccttgctttatcatccctctgtcattattttcaatcaactccgcattactcataatcctctatccgccattcgtccttccagtcgattatgacctgtccatagggatgcgcatcgtcggggtcggcaaacctgataggaagccagacataatccgatatggatgtatttgccttcaatgccttgctaaatggaatgttttctgttgcctttgcaaactctgcctgaaggtttttatcagtataaaagcttggatcagtgtacagcttaactgccttttcaacatcagcgtatctgatttccgtaaactccggcagccaacgatccgcgcaggccatataaagatcctttttacccgggaccttaaatactgacgcaatctgcgaatggaatgatgtatcagtaggatcgccaggatgcacccctcctatatctacatacggcccatgccatgtatctgctatggctgcctctgtaggattcggaaaatatcctgttatcccacttgtaagaagataatgctttccctttctatagaagtgcgccggggcctctcgtatataaggggcgcacggccttgtaagatgcgtagaataatatcctgttatatctgtgtaatcatcggttatatcggcgcatattatctcactatgcaccctctcgaaatagtaatatgcctttccgtcaggcgctatcgcaagatcgaaatcacctgcgctcatccccagcggcttgatgccctcttttacaaccgtatatggcccaagaaaatgatccgctgtcaatattgtcgtcatctgaaaatcatcatagctcattattttcagccagcacacatacttttttgcggcgcgattatagataatgtgcggcctgtccatattgcggtacgggtgaagcgtagacttctcatcatcaatatcaggttctattatgatccccctgtcctcccaattataaagatccttggatgaataacagcgcacgccccaatgccatattttatcttcccctgttgttttctccttgttctcaccataccaatagtaggttccgtcctcataaaacaactgcggtgcgtgagcctgtatccgctttccttcggtgtcaagccaaacctctcccggtctgatagaattgtataccatttccttctcccttcgataaatgtttcagacgattaccggagcagactaatcctgcgaaaatgtatcccttatgcgcatatctactaccgttcttttgttacgcattaatattaagaccatttttccctcccaacaatatcactgaacgtattacagggcatatttttgtatcatattacgtcatatgttttctgtcgtgaattaattgtatcttatttcgtccatttatctgctgttttataacatattacgtccatatcttttcttattttttaaattatgttagaatgtgataaacacaatatacgggaggcgcttaagacatgtcgatttctatgagaccatcctttcatggtggtaaggataacctgaaccagattttttctctctactataatcctgattctgattttttctatcagaagacagagatttccttttttatcctgcttttaaacgtacattctggcttcaaggaagaaagcacctattctattttcacgcctgaatcacagtacaacggtcctataagctctatagccggaagaacaagcaatatgctccaccaacataacacctttgaattcacctatgtcgtatccggcgggatgtatcagcttgtagaggggaaacgctttttttatcccaccggaagctgctgtcttatgaaccgcaataccttacacactgaggatgtttcctcctcggattttacctgcattttcttttcggtgtcatcggagtttgtgcagctccttgaccagcaggcgcaatccctgctgtttccacaggagaaaaagcgctttgataacctgatatttcatttcatgaaggataattcagaaaaagagcacaaaggctccaaggactttctcgatttcgtgccgcgcatcacggaggatgagcagaaagttatggtgcatgatatttttgaaagtatgctgtacaccctgctgaacccgtattacggggcgacataccgccttcaggatctcttcttccagctcatcgatatcttatgcaatccaacatattatatcgccacgcatgttacggcacaaagcagtatggactccctgctcttctcacgcattgaccaactcttaaaggagcgtaacggacgcatcagtaacaaggagctttcccttctcctcaactatgacggctcctacctaggcaggatcgtaaaaaagcataccggcaaaagccttttcgactacagcatgaccttcacgatggccgccgcaaaggaaatgctttccagaacaaaaaaaagcgtgtccgagatcgcagacgagctgcatttttcaaatcgaacacacttttataaattatttgagcaaaattgtgggatgaccccgaggcagtacagaaaaatgaatgtcaaagaatgacatcagatatgcagtgcctctacatcaatcctctgaccgacctgtacacttttgcgtacctcttataagccgccatatatttatcattaacctcttttttaggccgataggtgcgaaccttcctgaccattctatccgccgcatcatcgaggtctttaaagcagcctacagctatccccgtcagcatcgcgcttccgacggtcccggcatcgacggtctcaagcgctgtcaccggcatacccagcatatcggccttcatctgcatccagacgcttgagcgcgccccggcgcgtacgtccggccttcatgctgttcttcatacttgttttcaaggtattcgtttccgcgggccatgaccttcatatcgggtatcccgtcatatatgggtaatgcactcatccgtccactcgccgtcaaccgctatatcggagataaagactcccgtgccgacggcaggcgctatctggtcgtggcttatgcagactatccttgcagattttgacaatccggtcctctccatcgtccttgtagcaagggagtagtctatcttcgcctgccctgtatgatggaatactacaaaatcctccatcaaaaacacgcgcctggcccttgcgaagatatccggcttgttgccgcggagccacatgagcttaggcagggagtacatctcatgcggctttatcccggaaatctccgcgtaccaactcatcctgtgggaggatgatttacatcatcccgaaaaaatctctaagcctatcccggcgtcagccgtggctctgtcgaatggaataagacctataaaatccatcagcatcaatacatacgcagtttaagaccactcatcgcataaaggctgctcaacttcatatctgtatgaagcttatttcagtgcgtcaaaaatatgagatcaccgcctgcatctaaataattctgttaaattctttcaccgcgtcaatcattgctactatattttccacaggagtcattgcctgaatgttatgtatcgtgttaaaaacaaacccgccgccttctgagaaaatacggcacatttccagtacttcttcccgtacctgctcagcttttccaaaggcaaatgttttctgcgtatccactccgccgccccagaatacaatatcttttccgaactcccttttcagctcccggggatccatattttccgctgtccactggaccggattcagaatatcaaatccgcattcgatcagctctgggatcagagccttaattgacccacaggagtgcttaaatgtcttccacgatgtatttgcatggatccatttattaatcttcttatagtaaggcatatacagttcccggaaagtttcattcgagcagaatggacacttctgggtaccaaaatctgtaccgcaggtaaatgcggcctgaggaacatctcccaccgtctcttttatttttttcagattctcaagagctatatccgtctgtttttcaaaaaccgaatgaagataatcctggttagtcagagtggcaatataccattcctcaatatcccggataccctttggatgcttcagcatactgccgggtacaaatgccacatcaccgataccggtgcctccgaacgcagctataacgccataaccacgtttctctgccgaaacgcactgtgtgcggatagatttcagatcttcatccgatatataaccgaattcttccaggttatcctccacatgcagattgtcctcatcatagtcctctccccttaacaggcaatcaaaaaaatagccgcccagaggcatttttgcagttggaggaaggctgcggtcccccgccacatataggaacacatctcctcttgcatccatagacgtttcaaagttatctggtactaggatatcctgcccccagggagtccgccactctttactgccctcatcccggaacccaaagatcgtgtttggattccaaatctgcgtagtgtctatccccatcgcctgcttcagatcctcatccacagtccccagcatctggagcggctccatcagacgcaccggacgtttttccaggccataatattctcttagcttttctacaattgatatatgaacccctgtcaccgaggtcgccccgatatccaagggtaccgggccgctgcgatgtgccagggccctgctgattttttccctgctatccatataagcttctcctttcgcaaaggggtctgacccctttgctcaccgttttcagaatattctcatcttttcatgaattacattttctttcttttcttccccagctggtcaatcaaaactgccgtcagcagtgttgcacctgttacgaaggtctgccagtagatatccacgcccagaagtgtgagggaattggtgattaacgccatcagaagtgacccgagaaatgcgccgaaaacacttccttccccgccttgcaggcttgccccgccgatgataacggctgtgatcacgcgaagttccaagcctgtgccctgctgcacggatgcggttcccatacgggctgttgccacgattcctgcaaaaccagccagcaggccgacggttacatagttcagtatcttgatcttgattactttgattccggaaagttttgcggatttttcgtttccgcctatgtagtagttctgccggaaaaacctggaatgccgcatcagaatgtcgcctatgattacgagtattatggcataccagatcggcgcctgcacacccagtaccactttctgccctatggcgttgaatgcatcccccagcccggttacattctgtcctctagttacgatcagagtcaggccgcggaacaggctgagtgacgccagcgttgttacaaatgcattgatttccagtttcgctataataaaaccattgaacagtcctaccagcccgccgattactactcctaccacaaccgccacaataggcggcattcctgctttgagcaccagccccgcacagactcctgaaaatgccagtatggaacccacagacatgtcgaatccaccgctggccataagattcgccattcccaccgcaatgattacctcaatggacatgcccagaagcaatgccacaatattctgatatgtcaggaaaacagaggatgcaatcgtcataatgatggacaggcccaacacaatcagcacaattgccgcctccctctgttttaataatttcttaatcatattcatatctgcctccgctctgccgccaagcggcacctctactctgtactaacacagtcaccctttgttactccggatgccagggcgattactttctcttctgtcgcttccgaagccgggatgattcccacatttctgccttctctgatcaccataatccggtcgctgactcccagaatttcaggcaggtcggacgagatcatgataatacccacgccggtttccgccagatttctcagaagattgtatatttcactttttgcccccacatccacgcctctcgtgggctcatcaacaatcagcacccgcggacggatcccgaaccaagcagcaagaagcaccttctgttgattcccacccgagagcttattcaccaactgccggattccgggcgtagaaatgcggaaatcctttacagcatcctgcaccatctgatcgacctgcttttccctcaggaagcctctctttgaaaaatggcgcaactggttagctatcaggttctgccggatatcaaattttacatacagcccctgctctttccggtcctcgctcatataaccgatgccctgccggatcgcatcctgcgggcagtggatctgcagtgtttccccttccagcactacttttccggcttccagaggctccgctccgaagattcctcttccgatttctgtcctccccgctccaaccagacccgatacgccgagaatctctcctctccttacctgaaaagaaatatcccggaatgctttccccctggaaatcccttcaacctcgaaaagcacctccccaattttctgttccggcctccggcgtccgtaaatattttcaattttccggcctaccatgttcgttatcagaaaatcctcgtcaatatccgcgaccctcgcctccgcgatgtatgccccgtcccgcagaatcgttacactgtctgcaatctcaaaaatctcctgcaggtgatgtgatatataaataaagctgattccctgttctttcaggatgcggatattctggaacagcttctgcttctccacctctgtgagagaagatgtgggctcatccagcacaagcactttcggcctgaaagacattgctttcaggatttccacaacctgctggttggcaatcgccagttcctttacaggcgtggcgggatcgatattttcaatctcgaacagtctcagcatttccttcgttttgctatacagttcttctcttttaatcagatttaacttattgaccggctgacggttggcaaatatattctctgccacacttagacacggaaccaggctcaattcctggtgtacgatactgattcccttttgcagtgcatcatgggcggaagtaaataccactttttctccttcaatccagatctccccctcgtccggcttatggatcccgccgagtgtcagcatcagggtactcttacccgcaccgttttctcccacaagggcatgtacttctccctttttcactttcaggtctaccccgtccagggcacggacccccgggaaaatcttgacgattccttttgcctccagtatgtattcagacacaggcgccctccttcctttttacgaattcattgatacgaattctttttatgaatttatttcaaaattcctttatgaatccccttataattcctttaaaatagtatggacggtgtaatcccgcccatacccttgtcattatctcttgaaatactcgtaatttgattcatccacaataatagcgcctgtgtcgatatagccgggtacccctagtacgcctgccgctgcattatccgatgtgatctccaccttggagttattcagattaatcagaagctgtgtagcataatatggcattaacgccgtctgctgagcaacggatgcggaaataatgccatcctcaatagcctccagaatctcattggaacggtccattgcgatgatcttcacatcccctgtacgccctgcttctctgactgctgtagccgctgccgtgccgccagtcgcatccacacagacgattccgttcagatccgggtgtttctgaagaactgctgcgatattttgtgccgcaattacactgtcctgtttggtatccacttcctcaataatctcaatccccgttccctcaaatgcctgcttatagcctgccacacgttcctccagattcgtctggcccggattatacataatcgctacttttccactgtcgcccagaagctctttcatcttctctccgcctgtaattcccgcttccacatttccggttccaacaaatgcaattctgcctgaatccggaagatcggcatccaccgtaacaaccggaattcctgcgtccatggctttcttaattgtgggagtcagctgctcgttgaaacctaccaccacgattccgttaggtttctttgcaattgcctgctcaaatgctgtaaccatagcattcatgtccagctccgcaggccccacaaattctgtgcgcacgcccagctcttcgcccgccatctccattcccattttgtgatcatagaaataggggtctgaccctagtgcggatacttgaatataaagctgatccgacagattactctgtgaatccccgtctgttccctgcgcatcactcttcgtgtcttccgtctttgccgtggtttccgcctccttgccgcctccctgacaggcagtaaggcctattgccatcgccagaaccaaaacaaccgcaaccattttctttttcataacattaccttcctttcctttttcacttcgttcatgataatttcattttacataaacatttcggttctgtaatcaacaatagcttactaaattagcatatttttataatattttcattgcattattggacgcattgtgcaaattgcctttctccaagtttaaaataatgctaatttcttacatccttcttgtttttgtactggtgcaaatgtaatatatacttatagtatagaagaaacgatttattataacaggcagcgcggtctgcctcgacactcattcttatgaaatgtatttgggtaaaaggaggtttttacatgtccgcagagacgatttccgtccggaattttctggttacggtttcccaggcagtctatctcgaacaggctcctatgacgctgcactttatcaactgtttcagcagctactggaggtatatcagccgcccggataaagaggcgcctttaaaacaagaactggacatgctgatgctgatccgtgaaatttttatctcgattcccttcttccagatactggacgagaatctcccggaaattccggaagagctgctgattccaagaaactgcattctggcacaggtctgggaaaacctggagcagctctccaatgcctcgcagacctataccgccctttattttacctggaacagcccgcacagttcactcgaactcaccggcatgcttcccggcggaagcatttctgccctgtacgaaattacgatttaggaggccctatgtattctgtaatcatagtagacgatgaagctttatccaggtatgcgctgcacgtaatgctcagcaaaaatatgcctgatctgaacgtggctgctgaatgtgaggacggagcctctgcggttcaggccgccctgagatacaagcccgatattgtaatcattgatatcaaaatgcccggcatgaacggactcactgcatccaaaacaattctggagaatctgccgggtaccacgatcctgatcctgacggcatacgacagctttgaatatgcaagagaagcgctcacaataggcgtcaaaggatatctgttaaaaccgctgatagaaaaggaggtaacggaaacacttcaaaaaatcacagacagcctttcccaaaacagagcaataaaagataaagatgtggaggagaaggagattgtctccctggcaatcccggttataaaaaggaatctggtggccagttatatcaatggtacggctgcgccggctctgctggcggaatacagtcccctgctgcccgggctgaccgactccggcttttttatgctgttcccgcttaccccgtccccggacagcaccctgcctttttcgctccagcccccggcagatacatacaaacagatcaccgaaagcatttcccagatgataaactttcataagaacgtactgatcggtgaggtctcttttcatgttctccccctgttcttccatatttcaccgtccgatccgtcctggcacgagacagcctgcatgctggcgcgcaagattatcactcttttaaaccagcgttttaagctgaaaagcggagcggcctttggcggtgtctatcatacctgccagttatttaaatcatcctatcaggaggcattggaggtgctccctgcgcttctgcccggcaccgtcatagagtacaccccggtttccaattccacccataccgtctacccatactctttggaggaacagtttatggactcccttcgcagcagaaatacggaaagggcccatggctatgcacagcagcttttgaatgagatctttacggcccggaattctctgcagatttcaaaagaatattccatccagcttttgtctgcactaaaaagcctgctccaccagcttggtttcaggcagaccagctttgacctgtatccattcctatgtcagatccagtccagtgtgtccgaacaccagttaaaagaatacgttaattatgcactgcattcctttttagagttcctccagaatgaatctcaggaaaaaaactatgcacttatgaaaaagatcaattactatatagagcgcgaaccgatacagatggtatccctggagggcctgtccagttatctgaatctgaccccgcagtacgtaagcaaagtatttaaggaagaataccatcttaattttacagactatatcacgcagaaaaagatcagccttgccaaaccgctcttggaaaagggtatgctttccgtccaggatgtcagtattcaggtgggctacagcgaccaaaactatttctgcagaatatttaagaaaataacagggcttaccccaaaggagtaccagaaatatgcgaaaactctttaactccgcctcccggctgtccactaggcttttacggtattttttaatcattattctgatcatgtccgggatttctttctattccatacagtccagccgcagcctgaaccgggcaaacaacgagacgctggagcatatccagagcctccagcttctgcttgtttccctggaagaatccgctaccaccgcgtccaattactatgcacatccgtcccccgactaccgcagaaagttccaggaccagtgtttagacgcaatagcctgcagcgcatctatgcggcttctttacccgggctcttatctctaccgcgatatccaggtcatgaccgagtcctatatggatgccacaaccagactatttgacaactataacccggatgcggcctcctacctgtatacacgggagcgtgtcagtttggactacataagaaataacatttacaattatatttataagggaatgtcctcggaactggaactggcggatgcgcggatccgccagaatacaaacggcctgaataccagccagagcagtatctatattttgctggtatttttcaccatgttctgcctgtttatttcctatcagatatccgcatatcttgcaaagccaatcgtggagctgagcaaaaaattccggctggtcgcgcagggagacctgacggtcagttatacgccgccctcccggcagaatgatgagatttgcctgctcgcctgctcttttaacaagatggtactgcagctgcaggaaaaccaggagcgcctgctggaaaaacagcgcgtagaagcccggctgcagaatgaaatgctgaaaaatattgagatgcagaattccctgaaccgttcagagctggagtatcttctgatgcagatcaatccgcattttctgtataatacgctgaatacaatttctgccatggcgattatcgagtctgccacccttacaaaagacatgctggactgcctctccgggctgcttcgcaacagcctcaccgttatgtcggagaccattcctcttgcaaccgaaatccagactctcacctactacctgcagatccagaaagtgcgcttccagtcccggcttcaatacaggctggatgtttctgcggactgtcttgatgagagcattccggccatgattttgcagcctcttgtggaaaatgcgattatccacgggctggaggaccggccggaggaagggaatattttgattactgcagagaagaccgaggatactcttatactttccgtggcggacaacgggatcggcattgcgcctgaactgttggaagagctgcagacagataaacagtctgctaagaaggagcagaaacgcagcataggtatttacaatgtgaagaaacggcttcatctgatttacagccataacgtcatggaaatcacaagtacccagggggagggtacttgtattacgctgcggctgccgctttcggagccgtctctcccgcagcagccgagtcaaaacctgacggataaaagaaggatttaaaaaagaccgcccctgctctcgcagtgacggtctgtcagctttgattaatcctgtacgtatggcattaaagcaatgtgtcttgctctcttgattgctacggtaagagctctctgatgctttgcacagtttcctgtgattcttctcggaagaatcttgcctctctcagagatgtatttctttaactttgctacgtctttataatcgatttcgttattctctttaccacagaatacgcatactttttttcttctgcgggccggtcctcttcttttgaagccgccttctggtctgccgcctttttcgtaagccatttctttttacctcctatattaatagaaagatttcacaaccgtgtcttaattaaacggtaattcttcgtcgatcccatccgggatattcatgaatccgtcgcctgcatcaacacttggtgaagggcttggagctgcctgctggaaagaagagcctctgttggcttcgctctccgctctgctctcagcaaattcctggtcctctacaattacctctgttgtgtatactttcacgccgtccttgttcgtgtagcttccggtctgaatacgtccggaaatggaaacacgcattccctggcggaaatacttctccgcgaactctccggaacgcccgaatacaacacacggaataaaatccgctgttggttcgttgtccctcttgaatctgcggtcaacagccaatgtatatcttgcaactgcagttgcactatcaccctgtgaatatctaacttccgggtctcttgtgagacgtcctactaaaactactttattcatatatacctctttctctatgcttcctgtctaacgcataaatatctgagcacattgtccatgatgcggatacgttgttccacttcgcctgggacagtactgtcagattcgaagtggatgaagtagtaatatccttctttcatcttctgaatttcgtaagcaaatcttctcttaccccattcatcaacgtcagtcacattgccgccgaaacgtgaaactaatgctttcactttttcaacaacttctgctctagcgtcgtcttcgatttttgcactgacaacaacagctaactcatacttgttcatgtctcttgcacctccttatggtctctggcccccggatcacccgggaacaaggaaatttgatgtccgtggatatagaatcctacgggtacgtcacgagtaattatcataccataataacttgtccggttcaagactttttgcgaatttcttttgtatttttttccaccagcttacgtggaaccatgatctgatggccgcatcccacacatttcagccggaagtccgcgcccacccgcagcacctcccactcatggcttccgcagggatggggctttttcattcggattatatcaccgatatcgaatctttctgccacattcatcctccttacccatcatatattctgaatattctgaaaacgagccgcataggggtcagacccctttactcttccacaagaactccctggagcaggaagcgctcgtcatcgtttacattggtgcatgttgacaagctaacaatcctggactggccattcacctctacatccacctgatagtttgaagactctttgcaaagctggagatagctggagaattcctcatcattcagataagttagtttgtaattgtcggccgtatctttcacggttcctgcggagaatacctgatacttggactctccttccggggtataaatgtagaagtacggatgtgccttgcagaattcctcactggcgtactcgctcagctgggaaaacatctctccgcccactttcagattgtgtccgtatatgaatgtgtttctgtcgctgaggttcgtggcgtttcgcatatccataaatattgcacccagcttgttgtcattggctgtaaatgtttttgtcagatactctttgttatctgcactttttacaacaggatagctgattactgagggctcatcaaacctaatccatgctacggtatccggattttctttcaacagtgcatcaaaatccacagtataccccggttccccgtcctcctcctcgttcttttcaaccgaaagcgccaatttcttcacatcgtcatattcttttccgcctgaataataaggtaccagcattatggtaagctgatacgcgcaaaacacaaatacgcatattgcaataatcaatatggcggtagatatgacttctccaacagagctttcctttttatgcctttttttcttactcatcgcgtgtttctcctcttcccagtctcttcatccgttctaacagcgttccaatcctgattattgtaccatatctctgccttaaaaacattctaaatataggaatttgcaaaaatcacaaaaatagcttttatccattccttctatctgcgcggtatggtaaaataagtatattgagacagaggaggtgatgctattgaaaacactgctgatctgcgacgacgataagagcatcctggaggatctcagcttgcgtctgtcccatattcttcctgaaaactgggatatcaaaacgtttcttgcccccggtgacctgcgtttatatttagaaacttccgcttctctgccggatattctatttatggatattcaatttggaactgaaaatggcatctgtctggcttctgacattcagacccgttatccctggattgcgattgtattgatcaccggatatctggactatgcccgagatatctttaccatacaccccgcctattttcttgtgaaacctgtcgatacggacaagcttacggcggcaatagaacgggcccttgagtatatggactgctgccaggataagccagttgccctgcagagcaacggcaggatcttcacattaaaaagcagcgagatctgttacatagaaagtgaaaagcgccggctgcatgtatatacatcggaagaaaaatttacggtttatatgaaactgattgagctgaaggaaaaacttcccggctgttttttatcctgccataaaagctatgtggtcaatatgaattatatccagaattttacggcgcagaagattattctgctgaatcaggccgagataccggtaagccgctccagatataagaagtcaagagaagaatttctacgcttttttagtacggaagattataatacataaaacgaatacctcgtaaaaggaaaatgttatggttctatataatatcatcaggctaaccctgataacttccctgataatctatttaataagcccggatgtcgaacagcgtctttcgtttgtacttgcgtttacaactgcatttttcctgcccgcaagtatttctattacaaccacttaccatggtgactggcagattgccgctgtcagcgagcttttccgtttcctgatccagctggcagtctgctatctcttcaccggacggggaatgtattatttcgtaaaatatatggtacatttcatcctgttcaactgcattttttccggtttcacaaccatcgagggacttgtgctcggcaattggcggtatttcctccagggtatggcattcctggagaatactttgtttccaacattgctgtcttgtattgcattcttttgcgtattggggatcctgcagctgaagcttttcgaccgcgtcccctacactgtcatgaagttcctgttcgcggcggtattgctgctcgatctggcgatggggctgtttatgcgtcttaccaatggaagcttaaccgtactggccagtacgatcgcttccggaacgatactatttatttttctggttgtttttgtctggtaccggcaaaagcaggcttaccagctgcggaagcattatgagcggatactgcaggaggaatattctttttatcagaatattcaaatccagaaggatgccgtccatcagctccgccacgatcttgccaatcatctgcaggtgttggggaatttgtcccaaagccatctggaacaggaagagcaacagtacaagcagtctcttctgcagttatttgactgtatcctgacctcgtttgggaaggataccacttctggggatgcaaaaagcgggattttccgaaaactcatcccgcttcttattctttccttccttggagtctttatattgtgggaaatattctttccttttatggatcatcggtacaccgtgtacgaatggacggctttttactggtttttcatcctattcgcgattgcctgtgtcgtagtctgttttggcgcatatctggaatacaaaaggcacagagcccttcagacgctggaaggcgcccaaacattcagaaaacagtgggaagatatgatgggtatggtcgaaaatctaccattagaaggtagtataccgcctgctcaagaactaaaatccttcacaccacagcccgtggtcaatacgatgctgaatgccaaataccagtattgtatccagaatcatatttccacaaactggcatatttatattccgccagagtgttcgctgcagtccgtagaaatcaccggtctgctggtgaatctcatagacaacggaatcgaagcatgtctccgggtaccgcaggacaaacgcctgttgaatatctgtatgcaggaacgggcaaatttttggattgtggatgttaagaattctaaatcacctttggagcacccggagaaattagattttatttctgcaaaaggggacgggcatgggcttggactccagattatcagaaccattgtgaataaatacaacggagatattcaaagtatggataagggagactgttttcttgtcaccatcatgttagatatacagaaactgggaactgtataatgtttcagttacctgccccatactgttccagaattttatagatagcatgcgcagctcccaggtcttcattcgattttgtcacatatccggccgcggcctttacctcaggcacggcattttccatagccacagtagccccaaaatccatggacaacatggaataatcattcatgctgtctcccagcaccatcacttcatccatcttatatcccagtgactcaatatactgtttgagcacggggcctttctgcgccttcacatccgtaatctccaaatttgtttcgaaagaagacgccactgcgatatctttgttctgttccagttccgcccatatccttttcaacataggaatatcaccggaaaacaggaagatcttatataccggcactcctgctgcccttagttcttcaaaatcagaaatcttctttgtcatttttttaatctgctcatataaaggctcctttttagcctgtacttcattgatgtctttatccagatgaaacaccttaagctgccggataaaactctcctcaatttccgcttcagttccaatcctgtaatcataatcatccgtagagaaaacaagagataccggatatttttgcagtgtttcatagatttccgcacacaaatccagatcaatcggcgccgtaaatacgacctgtttttccggattgcgcacctcagctccacttcccactatgtaatcacagtacaggtctgcgtctttaataacttccatggctccccggaagtttctccccgttgcaagcataaaacgtatgcccgcagcacacgcccggcgtaccgcctccagtgtctccggcgccagccggtggtcatcattcaacagcgtgccgtccatatccgatgcaataactttaatcatacttcatctccttctcaaattgttaaactattctgaaaatggcacgcaaaggggtcagacccctttacagcattccttccacgccgtccatctggcgtacaatatcatgatgcctttcgtcaaacagcagccccttattataccggtagtaactgtcgcttccattctctttgataaaccagacactataatagtttgcattcagttctgttataaacgcgaccatctcctggctttgtccaaatgcatcttccaaaaaatcgaatacatattgcagtgtccgggctgtatggtctatttcgtcttcccgcttatccacttctttttcaaaaagtgccttgacctcatcgaacacaccgtccccgataaataattcgcctttgatacttatggcaaatctctcaagcgccgcaatgactcgttttaaaaccaattcatcccgtcgggtcagcagttctgaacgcatctgttcttccagatctttttccgccaaatgccagatatcctctaccatggaagtgacctggttctccctgtagtagatcagatactcgtaaagttttgtcacgtaggcatctgtcatataacattcggtaaataactcgcagagtttaccattcaacaggctgacgatactcagatgctcatcaaacggggccgcctttaccttctgcagggttgccgtactccactttcctaccagaatatcctccacgccataatcctgtttgtatttgtaatagagctctagataatttgcgaaatctttggaaattgtgcggtgctggatatactggtacaccacatccctgtccaccgttttgtgcaggctttcataaacctgaatcagctgggaaagatcttcccacccccgggccgttgcaaagtatctgccatccaccgttgtttcaatccggtaaaagttctcttttctgagttccagataggatatcacagccgggtggatcccctgcctgtatgcatattccttccagacatcgaagttttcttccacatcaatcttcttgatccggtccagcgtcacgacatcaaactcccggacagacttgttatactccggcgggtttcccgcagccacgataatccagccctccggcaccttctgatttccaaaggtcttgccctgcaaaaactgaagcatcgtcggcgccagtgtttctgatacacaattgatctcatcaataaaaagaattccctctgcaatcccggtctgctcaattttctcatataccgacgcgataatctcgctcatcgtatactcggttaccgagtaattcctccctccatacaccttctccttaataaacggcagcccaaccgcactctgcctcgtatgatgggtgatggtataggccaccagcccaatctgacattccttcgcaatctgctccataatctgcgtcttcccgattccgggcggccccatcagcagaaccggcctctggcggatggcgggtatcctgtattcaccgaactcatctttcgccagatatgcttctatggaatctttaatttcctgttttgccctttttatatccatgcttttccctgtcctccagcttacattttttgttccagatcttcctggcccaatgtcagtttgatcgcccacggcggtacatccgtatcacagtaatcatcctgcataaaaacaaatgccgtcttataagcaggcattttccggggatatatgccatacccatccgtaaaatacagaatcccccgcagatcttcaaagctccctttctctaccagcgcatccacataggcaaaagccggccggtaatccgtcccgccttccccatacagagtcagatgttccatatattttgccaactcttcggcattggtaatacattggtccgaatgcactttctcatcacattgtatcatatgaatatttacctttttaaagaaactctcctcttcgctcaataccgaatacgtctcttccaaaaaccttcttaccaggctgcctgaacaggacatcgaagtatcgatcaccactgcaaattccgaaatcttctttacttcctttgtctcctgcggctcaatcaaaggcatattcccataaagccgcagcccgtaactgtaaaaagaataatcaaaactgtccgcatccacaccgatttcttcccgcagtaccgcaaactttctcaaaaactctttataattataccggtctctgttctcaatttttatctgatccagcagatcccccgcctgttgggatgactcttttgaaaatgtctccaaatccgtttccatgcgctcattcatatcctgccacttccgctgcaggtttggatccggcttctgctgtgggtatttattttcccaatacttgtggtcatccacataaaattcctgctccaggcgcgccagttccttctcttccaaattccagcccataagcagtgcatagacccgctctgcattgagcactttcctctccgcctccagcctgcggtaagtctctcttctaagaaggctcctcgaaaaccggacggaacggtgctgattcccatctatcatatgttcaaccgcaatgtcacagctcaggtcccagtacctgtcatccagttcccgtttgaccatatgccggaaaatgcaatggaataccatgtgcagataacctctatttacgagaatcctgttttccctgtacatcccacccagatactggggatggaaataaatggagttcccgtctgtcccaaaaggatttacagtaatgtccatctgatataagaaactgctcagcgccacatccagaaaacgcattcccagataaagttcatcccgcgccgcaaaaaggatcttattccccaccgtctccaggcgcactgctatctcctttttctgctcactgtctaattcaatcaccgccggttccctcctctctcctgtgcactgcaaactcttattatatcgtacctctcccgtcaaagcctaaactcttttctaaccgtcgggaaagatttctgtttctcattcatcagataactaaggatctctgtcccgcccatttctgcggctgtttccagcgcaaactccaagatatctgcattccacagcgcatgcgccgtaaataatttgatttgatcaaagcgttctttttttattagatacggcacaacttcctgatacctgtctcttaacatattttcataggaacgcttatgattgtcagacaaatcatatggacaggccagccgccacaatgccatatctgccagaacatctgctttatcccatgccgcggcaaccgaaaaaagactgtcatatttgcggtaatccactactttattataaaaacactgtctgtaattatttccggaaccatgatgctgtgtaaataagatccgtgccggcgtattttccaccgcttcctcataatgttccgggaacacaagaaccgcttttctgccttcctgctcatagcagaacgtaacatcaatccgctgccacagttcccctaagatttccttcacgcaggactgcctgccggacttcatatgcacctttaagaaggccagtcccccgcagccggtaaaagcaccgccgccgatctgtaccagcgcatcggagaataccagctttcgcaattttttgcagccataaaatatataattaccgatttcccgcaccgtatccggaaaaatgatttcttccacattcaacccggcaagaagctcttcttcgcccttaaaaagggcatgatcttccgtctcatagaccaggaattcctgttctttattgtccctgcggtcagaaaatgtataagcagccaccttttccacaggcaaaccgtcaatatactccggcaggattactttcccgtcgcatccaaaacatctgataatttcaatagactgattctgttcccggtaataaaacttcataaatttctactgacctctttttactccatttgccacctattcattataaaagtgcggggcatttttttcaactgctctatttattttatcttttactcatgtttcacttcattatattaaatgataacagatggggccggcctgaactgttatacatccagcccattgtaattcgcctggggtgaagtgctggatgcctgcagccaccttgctttagtaagattctgcagtaattgcacagctccgtctgcactgttatatcaaatgatacagaattaagtttaagatttatccttgcatatgataaatcaatagtgtagtataaaatcagtgattttacaaatgaattagggggattaacttattatggataaaatcgcagtattaattccgtgctataatgaaggtaagaccgtcaccaaggtagttaccgactggaaagaagcccttcccgaggcaacgatatacgtatatgataacaattcttcagatgacactgccatactggctaaaaaagccggcgccgttgtccgccatgagtaccagcaggggaaaggaaatgttatccgccgcatgtttcgtgaaattgacgcagaagcatatttaatggttgacggtgacgacacatatccagcagaattcggacgtgacatggtggacaaggttcttaaccgcaatgctgatatggtggttggtgacagactctcctccacctatttcacagaaaacaaacgaccgtttcataatttcggcaattctcttgtccgaaaagcaatcaatttgctctttaaaaatgatatcaaggatattatgaccggataccgcgctttcagctacaattttgtaaagacatttccggtactctcaaaaggattcgagatcgaaaccgagatgagcatccacgccgtcgataaaaatatgcgcgtagaaaatgtcgtgatcgaatacagggacaggcccgaaggcagcgagtctaaactgaacacttacagtgacgggatgaaggtgctccgcacaatcgcaagactttgcagaagctacaaaccgctgggattcttctccgcctttgcacttcttctggcggttatcagcactattttcattattccggtcatcgtaacctatgcgcgcaccggcctggtgcccaacttcccgacactaatcgtctgcgggtttgtttacctgaccgcaatcatagcattctttgccggactgatcctatcctcgatcgtgcatcagtaacggcagaacttcgaaatacgtctgatcgcatgccagcatcggtatgaccttacgttaaataacagcggggacggtgacgggataaaacaagaaaaccccgctgaatgggtttaaacaaattgataaacaattctgaaaaagagccgcaaaggggtcagacccctttgcggctgctttctttccatatcagccaatgtcaatactctacctgatacagataataccttccgattttttccgtctcattaaattggatttcttctgaactaaacccacttagatctttatccgtcataatgtgctttacttgaagtacctccagttgatcaggttgtagattcacaaccaactgatcatcatacggattgaaaaataccggctcctgagaggtctcgtccacaatattaatgataatatgtgcgtaacggttatacttactgaaatcttttttccctgggtcaaactgctcccagcgctccagatccggatatacatttgtggtattgatcgttggcgcacccacagtaatgggcaggttcagatatgggaagcccaggccttccaccatccacaaaccatctccctgatccgcttctgtttcttcctttatggccatggtcagtttactggaatagatagaatctgccccccgatgtactggatttaccgtcatcccacagacaaaagagataatcagtacatagcaggccaggcctgcatatcttttgcacttcatcgccgcaaaaatgaggactgccccagcagcgatgactgcgagcagtaccagtgccttcttctttcccataaactgcgtgtaatatataaaacaggttcccgcaagtcctgctccaattacagaagagataataacagcagttttgcttttataatttacaatactttccgagataagatagacgagcagcacaatactgagaaatccaactccgaccagcacccttctcccctggcacatactcagaagtgtggctttcgcaagcagagaaggccatggaaacgcgcagtacaaagcaagaaaacaagttcctgccgtcatcgtgattaacagcgcatccttctgtttgctcctaaaaatctggattatccctaaaattatacctaaggggaagaaagagaaaaactgcgcttcttcacaaacattagaaatcccaagaccgggatcaatatacggaaaaaacaaaccgcccgcccagctgaacattcttagaagtgaagctccccccacaaacgatctgccgccaggataagatgtgtttaataccagctcaatggtgtctgcggacttcaggaaaatggcccccagcgctccgaccatcgatataagaagaactaccgcactcaaaataatagagccctttttccatgttacgttcttccgctcccgcagaataatgcctatcagcagaaaaaggtaaacatatccaagcggaatctgccaggagggataaaataccagaatatatgctatcccacaccatgcaatccctgccgacagcaacagtttcttccacagaaattctgtatgcatccaccggacaaacataagaacggccagctggccgaacaccagcatctccaccagaccgttaattgcaaaccaccaggcaacaaccggtgaacagcacactaacagtgcatatgtcagagacagtagttttttcttttttgtcaaatacattccaaattccagtgataccaaaaacaacgccagcatccgggcacaccagaaaaatgccagcccccgcgaaggccccagaaaaagataaccgatttggaacgggcggaaaatgacctcccatgactttaccggctgcccgtatacaataaatgcatccgtactgtcccccctgattgtttctgaaaaatacgggtattttcccgtataattatattcctgtgaaaaagccatgggcgtactcaccgcccattcatccgttctgatgctcctactgcttcccagcagatcaccactgttatcctgggcactgctttcgtatgtgccgtcgagaagtacggaccagaacccaatggaagacccgctaatttcaaacaagacacagaataacagaataacgaccgccacaagataacgcagctgatacagcctttccgctaattgtcctttttccttcaaattcttcacgctcacttattctcctttatacaagattttccctctttgcacatgtctattgacataatagcttatacccaatatttcgtcaattatgaactttcagtccacagcctaaatcctcaaattgacattctattaaataagttatactctatattacagaagtattttttagaaaagagggagataatcatgtcaattgaaaaggtcaaagcatattttgccgggtacggcctggaggacagaatcctggagccggaggcatccagcgctactgtggaggaggctgcccgtgccgttggctgcgagcctgcacgcatcgctaaaaccatgtcttttctgacggcagacggtcctattctaatagtaatggccggagatgctcggacggacaacaagaagtttaaagcagagttccacgaaaaggcccggatgatccagcctgatcaggtggaagcgctgacaggccatgcaccgggcggtgtctgtccttttgttgtgaatgaaggtgtggaggtctatctggacgaatccttaaaacgtttctcaactgtataccccgcagctggaagcggaaacagtgcaatcaaactgacacttgaagagctcgagaaacattcccattccaagaaatggatttgtatctcaaaggattggaattagattctgaaaatactttcgggagggctgctatttgtaccgcattttaatagtggaagatgaaaaagagattcgtctagaactgaaacttatgctggaaaatgctttgtacgaggcagaagctgctgaggatttttctgcaatcccccgccttgtggaagaagctgccccggatctgatccttctggacatccagctgccgggaaccgatggcctgaaggtctgccgggatattcgaaaaaaggcggatgtgcccatcattttcgtaaccagccgcagcaattcaatggacgagcttaacggcatgatgatgggcggtgacgattatataacaaagccttaccaggcgcccattctgctcgcccgtatcgcggcggtcctgaagcggacggggcacaataaagcaccggagaatcccttaaggtttacctggaaaggctgcgaactggatatgctgaagggcgtccttacttatgaaggcagatccgaacagctgacccggaacgaactgcgcatctgctacaacctgttttcacgggcagggcaaatcatttcccgggaggaattgatcgacgatctctgggataatcagatttttattgatgacaatactttaagcgttaatatcacccgcatacgcggtaaaatgaaagaaatcggcctggaaaatatgattgtaaccaggagagggcagggatatcagctatgacatttttagaattcattaaggacaagatcctgcttctgctctttcaattactttgtatgctgttgagttatgtatatttgggaatctgcggcctgaagaacaatcagatgattttactttatctcctctggttcttcctgctggcagtctggttttttgtgtcctggtacagaagaaaccgttatttccgtgaaatattccatatactcaatggactggacaagccctatctgatctcagagatcatgccggaatcctggcgcctggaagacaggctctatcgaagactgctgaaacaatccaataaatccatcatcgacgccatacaccatctggaaaatgagcggaccgaatataaagaattcatagaaaactggattcatgaagtcaaacttcctctcacagccatgaatctgatctgtgataaccgcagggaaccagattcctggagccccgaggatacccgacgcctgaaatcccatctgggcgagctggaaaacgatgtggacaaggccctttactatgcccggtcagacacagtctgccaggattacatgatacgggaaattccactgaagaaccccgtttatgccgcaatccaccgcttccagtcatatctgatccagaacggcgtttccataaatatgcaggccggtactgaaaatgtatactgcgacgataagtggctggagttcatcatcggccagatcattatcaatgccgtcaagtataaaaaagaaggcgactgccttatcactatccgtacacaaaaagaggagctgaaaacaattctatccattgaagacaacggaatcggcatacgcccagaagaactgggacgtatcttcgacaaaggatttaccggcagcaatggacggcaaaaccgacagtctacaggaatcggtctctatctctgcaggaagttaagccggaaacttggaatcaccctagatgcacagtcagaatacggaacctatacccgtatcctgctgacatttcccgatggcggcagccactttggaagagattaaaagagaactttttcgctgccattcacggggccgcgcaccttgctgcaagacatccgatccaataaagtgatggggtcgggcattaagttcctcgccacaggcgactttaagtgaaccagatgccgttactatgcgcggcccgcagaccgcgcttagtaacaatctttcgattttgtaaggttactgaaagctgatttgatacaacctgatcacattttccgttacaatatttatatccgggggcggtccgcaatccacaacccgcggaataataggtttaaaaagccgctcatcaataagtaacgggaaaggaaggtattgatttcatgaaggaactgctccatatagaagatgtagaaaaatattatggaaacaaaaacaatctgaccaaagcgattgaccgcataagctttatcattgaccagggggaatttaccgcaatcatgggggccagcggcagcggaaagacaacgctcttaaacctgctcgcaacagtagacaccgtcacctccggacatatctggtatggccgggacgacattacaaagatgaacgaggatcagatggcggacttccgcaaaaacaatctcggctttgtcttccaggactacaacctcttggatacgcttactctgaaagaaaatatcgctcttgccatgtcgctcaccaaaaaaggaaaacgtgagattgatcagcagacaaaagatatcatggagagactggatatctggtctatccgcaacaaatttccttatcaggtctccggtggccaaaaacagcgctgcgcctgtgcaagggctctgattaaccatcccaaaatcgtatttgccgacgagccgaccggggccctggattccaaatcctcccggatgctgctcgaaacattttcctatatgaacagcgagctcaatgcaaccatcctcatggtaacacatgacgctttctccgcgagttactgcagccgtatcctttttctaaaggacggtcagatcttccatgaactgcgccggggcccgggaacaaggaaagaatttctaaatgaaatcctggatgtgctctccctgactggaggtgatgggtatgctgactaagctggccctgcgaaatgcccggcgctctctcagagactatctcatttatctcatgacaatggtgttgatcactgccatgatgttcgccttcaattccatgatcttctccgatgctgtccgggaaatctgcacggaagcaggaatgctggcggccatgcttggaatggcaactttcttcatcgtactgatcattatctggcttgtgcactatatggtaaaattcatggcggaaaaacgaagccgggagtttgctacctatctccttctgggtttccgtaaaaaacagattgccaaccttttcttaaaagaaacgatcctgcttggactggcggcatttgtcatcggcctgctccccggtttgtttctgcagcagctcctcaccaccttgatctacgccatggtaaatgcagactacagcatccggcttgaatggaaaatggctaccctgctgatgacggcgggaatctactgcggctcctatctgctggcccttttcagaaacaaacgcagatttaagaaaatgaacatccgggatatgatgtatatggaacatcagaacgaagaattaaagaacggcaacaactccggcaaacagtggatgttcttcgccgctgtggctttcatgatctttttcggctgtatgctgatcttcggccactttaacgattggaacgtgtatcccatgattctaggtctggtggtatccgtttacctgctctatatgggtctctccgctttcctcaccggctacatcaaaaaaggccgggccggcgtctggaagcatgccaatattttcgtgctgcgccagctttcctccaagatccggaccatgcagttcacgctgggcacactgacgatcctatttatggtcgctttaataggagcctcctgcgccctcatgctgaaccagttccagaacacacagtccgacgaaaaatggcccttcgacattgccgtataccatcagaacccggactacgatttcgcaggagaaaaggaagccatacaaaaagaggcaaaaataaaagacgcttatatttaccagatattcgaaaatgaatccgatgacatgaacaatttcctgattcataactattccctggccgacaaaagctcgtactacaaatatgacacctatatgatgctatccgattacaattatctgcgcagaatgctggggtacccggaagtatcgctgggggaaaatgaatatctgctccacatcaagtcccgcctggccaagacggccgcccccttcacggagcaaccgctcgatataggcggcacctcgtacacctgcgcaggcatatacacggaaggcttcgagcagagcgggcataacggggctgactacatcctcatcgtccccgatcaggccgccaaatccatgaagccgtattattcccttctgatggtccagattaacggcaccattcccaaggattttggagacaccctcctgaacatccaggggatcacatggaatgatgaagaatacgggtatgaaggatacggcgatgccgatgcacacagaggatacggaaccgacaacatctatgtctccgacagctacacctttgtacggcagaacgaaatgcgggaaatgaaattcctcatgtccaccctcattttcccgctcttttatataggactcgtcttcctgtgcgtagcactcactgtactggccgtgcagcagctaagcgattcaagcaaataccggtaccgttataacctgctgcgtaaactgggcctgcaggaaaaagaactgaacaggcttatcctgaaacagctgttcctgtattacctctgcccctttatcggtgcacttctgatcagcggaggaatcgcaggctatatcagccatgcattcgtcacatattcaggagtggtggcgccggtgtggtcttacttcggattatcactgctgctgttcggggggatgtatatgatctacttcatagcaacttatattgaattcaagaggaatattcttgggggtgaaaggtagacgtattcgtgaagagggcgccgtgagaaccggctgggcttccaaacacccccatatccggttcttacggctgggcgcttcatgtaggtacgttcactaaagcgtacagaaagcacactgaaagttcccctgctccggtagcagtcccgttccacaaaaacgacctccctatttccccgctccccaaccgctcacaaagttcgcttcatctcttgacggtttgagatttttttggtataatttaaaagctgattgagtagtatataaagtacagcaattagctaaggcgcagtagccaagcggtaaggcgtgggtctgcaacaccctgatcaccggttcaaatccggtctgtgcctctctcaaacttaagagtttaaggttcacaatgatgagttcatgattaagaacttgttataattgctgaaagactttgatgcagtacggacgtatcgccaacagacggtatgtccgttttttcttcgttgctataatcagctacttttaaaacagtttctttcatttccttattcatcatttcacttttcctttctacgtcaattaattcgcggatgactacttcataaaagtctgccatctcaattagaatatcaaagtctggcatattagttccggtttcccttcttgatatagttcttcctgagacatttatctgttcggctattttctcttgtgtcaatcccttttctttgcgcagcttcttaaagaagcagcctgcctttttctgatccattttcttctaatagttacctaaaacagtgtcaaacagtaacaagacaggcttgtcccaactgtttcgtcaaacggttcatttgggacataatttcacattttcgtgtgtaccattttatttaaatttcaacagaaaatcttttttgggaataccgtttgttatagaaatgttatttttcagtgttagagtgtatctgataagacatatagcgtgttgaccgggcccacttatcaggattcagaggcaaggcaggtacaacatttttcacgtcactatgagctctttcccgtgggaattttggctcgcttaattttatggaaaggaacgattaatatgaatgattttattctaaaaacggatgatttgtctaaacgttacggagaacaattagctgttggcggggtctgcctgaagatcaggcggaattgtgtgtacgggctgctgggaccgaacggggctggcaagtctactacgctgaagatgattaccggactgctgaggcccacggaggggcagatttattttaacggtaagccctggaaacgggatgccctggaaaaaatcggagctttgattgaggcacccgctttgtacggcaaccttacggcggaagaaaatctgctggtgcataccaggctcttggggatccccggcgaaaagattcatgaggtgctggatactgttaacttgaggaataccggtaagaaacgggcttcacagttttctatggggatgaaacaacggctggggattgccgtggcgcttctgaataatccggccctgctggtgttggatgaacctgccaatggacttgatcccttcggaattcaggaattgcgggaactgatttcttcttttcctgaaaaaggcattactgtcctgctctccagccatattctctctgaggccgcccaggttgtggatcagatcggaattatcagtaacggacggctgctgtttcagggtgaccctgatcccggcgcagatctggaggacttttttacagatattataataaatggagggtataaatgatgaatgggctgcgatctgaactccttaaatataaaagaacgtttatgggaaaactaattgttttggttccggtgtttttcgcaggatatgcgctgattatgcaggcaactcttatgaaacatcccttgtcacagaacagatcctggatgtgggacaaccttttagccctgatttttaactggtggacttttgtattccttcctcttggttttgcactttttgctgcattagcggccgggcaggaaaagaagtccggaaattatcgcgccttacgttcacgcaatgtttcacccatgctgctttggatatataaggtggcggctatggcggtctacagcctgctttctgcgatggttctgaccattgccgcaattctagcaggggtactcgcaaaatccggcgctatccccttccggcagattgcagcagcaagtattgtctgctgggcggcttcccttgccctgattcctattcagttgtgggcggctacgtggaagggactgtttctgagcatggggctcggatttgcaggcatggcagccggggttcttgccgcgcctgaggctttctggtttactgtaccctggagctgggcaatacggctaatgtgccctatcgcggaagtacatccaaatggttctgtattagaaagcggaaatccgctcatggacacttccgtgatcccaaccggaatcgcggtgtcaatagctgtatttctggccgtcacgctgcttaccgctgtatggtttaacaggagggaagaaaaatgctgaagctcttattatccgaatggctccggacaaagcggacggctgtccggtggcttactttttgtatgcctattatattctctctatgcacggctgcctatctggcagcccgggaaggaagtacgcaggcgtttgcttttgaaggatttttcacaatctggacagtgtttataatcccggcaggcataggtattctggctggatttattgtacaggaggaagagcttgccggaaacttttccggctatttaggaactgggctttcccgtgtcaggctatatgccggtaagtttttactactgtttttttgtgtggccgtgtgtacatttatcgcagtattgatcctctgcgcgggaatgaaggccgcggtgccggcaggagttaccgtctgggtgtttgtggcaggcgccgctcttgcagtcattggagcccttccgctgcttgcacttcacctgtggatcagcttcgcctgggggatgggagcctctgtcggcatcagttttggcggtcttttaatggcggcaatacttggcctgacaggccttggttcagggctgtggccgttcattccatggacctggccggtcaagctggggatgctcgcgggcacttatttcctgaaagatgccggctccctttcgcagacagaaattacatccggcttgataaaaacggcatccacaggactcggcgctgcagcagctggtctgattctgttcttgatcggagggatgatatggtttaacatatgggatgggagaaaaagctagtataagccatactagtaaaagagtttgttctttaagtagaagggagtgccatattgagtaaaatattgataattgatgacgaaacggaccttgtcatgctgctcgaggatgaactaaaagcaaagggacatgaagtgctcacagcttatgacgggcaaaaaggtattgagctgtcacgaaagcagccggatctgatcattctggatattatgatgcccggtatggatgggtttgaagtgtgccgggcgatccgggatgatgtcctgtgccctgttattttcctgagtgcacggcagtcggaaaccgataaaatcagaggattaacccttggcggcgatgactatataaccaagccctttggactgcaggagctgatggcgaaaatcgaagcagatctgcggcgtgagagacggtcacagtatatgaatgcggagaacaaacgatctaagctgtactttgaaaaactgtgcctggatatgagagaacgcactgtcagggttgatggaaaagacatagatttgaccaaacgcgagtatgacattgtagaattactggcactccatgcgggtcaggttttttcgagagaacagatctatgaaaaggtatggggctacgattccgagggaaattcctccactgttgttgagcgtatcaagaaaatccgggcaaaattttcagcagcggctgacaaagagtacatctccaccgtctggggaatcggatataagtggaataaaacgtaagaaagcggggtacatcctatgaagaatcaatcacttgcatcccagttcaggcgtacttttgtaaggattctgacagccagcgcaatcgggacggtgcttacctatgcgattgtcttttatttatttaccaaatccctggatcgtgacatttatactccagattattacgagcgtcaggttcccggtattgaggcttatattcgtgaaacaaacctggatctgctgtcgcagtccgaagaagccggcttaaagagtaccattccggacggcgggatgctttatctggttgtagatgaaaatggcagcattctctatggttcgaatccgcgaaaaccgtttgagacaaaggaagaattatttcacagctttgcagggacaactgtctttcggcatggacattacatctatacggttcctctcctggataacaacggaaatacagcgggggccgtccttctctcctaccagattaaaacaacttttgcaaataacaggggaaagctggtattcgcagctctcatcctggctctgtgctctccgtttctctacatcatcggttttacgctcctgtattccagagtatttgcccgcaagatcaatcagccgctccaactgttaattgatgcgtcaaaaaagatacaggaaaaagatctcgactttgaaattgactatcattcagacaatgaactgggcaggctttgcctcgctttttccgaaatgaaagaggaacttcagaattctctgtctgctcaatggaaaatggaacaagaacgtgtggaaatagtggcggctctgtcccacgatttgaagtcccctctttctattattctgggatatactgacgcgctgcttaaaaacaattctacgggagacgaaaagttatgccggtatctcagcgttatccgggaaaacgcgaaaaaaagcgcagcacttgtccaagagatacaatattcgtccggcctggagacatcagacatacagccacatcttgtgcctgtatctttacctgattttttgacgcagaaagtacatgaatttgaactgcaggcagggcaaaaggatattaaaatggttttagaaatgcagggttacatggagaataccatatggaccgattcagaatggctgtcgcggatttttgataatattatttctaacagtctgcggtataccccggcgggagggtcggttcacattaccataaaagccgaaaaagaacggattacgtataaaatttgtgattctggaagtggatttagtccgaaggatttaaataaagctcttaataaattctatcgcggcgatgaatcccggcagtcgggcggcgggcattccggtcttggactctatatcgtcagacaattagtggaacagcttggcggtaccgtcaggatagaaaacacaaaaacaggcggagcatgtgtgatgttttggcataaggtttcataaatcaaattattataaccggctgaaaaatataccgccggtgaacatcctctttgtcccggcggtatgctacctctaaaatcccaaattgtcattaaccaatatgacttttattctttccttcactcccgaattacgcgtcacaagcacctggcagcacatggaatttgcacctttgcagtcatagcagaatccgtcgttcctgcaaggtgtgtctatgcccaaacggacagcatttatcggggtagcctcattgtgcacacgactcagtgcttcttccacatttttaaccgctttattcattccaacgattagaattacatttttcgccccaaaagcaatggcagcgatccgattcccaaacttatctatattaaccagtattccatcatatgtaatggcattggaactggcaaggaagtaatcactgtcaagacatgccagttctgcctgacgcttttcctccggagtcttacagacatcccggttaatcacctgataattgccttcacagaccgcctgcttcagcccggtctccgtcacagaggctgaaccgccccagcctacactgcttccttccggcatcatatcaagcgccattttcagtgcttcctcttttgtcttcgcataataaccagccatattacggctttttagattcttaatcatgtgttctgcaagtaattgattgcgttctgcacggtaattatccatactttcatcctcctgtcatttatacggtttacatgttcttcacatattcattataagcattgccagtggaaaaatctacctggcagaaacattttgatgtcgttagtttcaaaggggttactgttcacaccctgcgggtgcgcacagtaacagcatctgcccattaaaagccgcctgcggcgaggcacagatgccccgaggccatcacctcattggctccgatgccgtgcagcggggtgcacgacacggtctgaacagtaactcaaaggggtcagacccctccgctaagaggacactcccctttgcagagggatctgacccctttgcacttattcagccagcacctgaaacaattccttcattgccgggtatattttcctaaatttccggtaacgttcttcatatttttctaccagctgtgcatctggttctacggtctcgattacctttaccagcttacctgccgcatcttctacggatgcatattccccgcatcctactgccgccaggatggcgcctccgtatccggggccttcttcgctttctatgacatctactttcaggttcatgacattcgcaatgatttttttccagagcgggctctttgccccaccaccgcatatttttgttctttcgatccggataccaaggcttctggccacttccagagagtctctcagtccgaatgccacgccttccagtacggcctgggtcatttcctctcttgtggtatccatcgtcattcccgtaaacgttgcccttgctttcggatcattgtgcggggagcgctctcccatcagatatggcagatagaacacctgattttctcccagtttgacaatgtcctcctgctctgcggcgtattcttttgtcttcagaatctcatccatccaccacttattacaggatgcagcgcttaacatacagcccatgagatgataatggccgtccgcatgagcgaaggaatgcagcgcattgttgtcatccacgccaaaggaactgcttgagataaagattgtgcctgatgttccaagagagatattgcacatcccatctcccaccgttcctgtacctaccgctgcggccgcattatccccggctcctgcgatcacctttacgccactgccaaaaccaagctcttccgccacatctgctttcatatgtccaacaacatcatagctctcatagatcgtgggaagctgctgctctgtaacgccacagacctccatcatttccttagaccagcgtttattctttacatccataagaagcataccggatgcatcggaataatctgtgcagaacacgccgctcagcttatatgccagatagtcctttggaagcataatcttactgattcttgcaaaattctccggctcattttccttcagccaaaggatcttgggcgctgtaaatccggcaaaagcgatattggccgtgtattcagacaatttgtcttttccaatcacctcattaagataaaccgtctctttttctgtccttccgtcattccagagaattgcaggccgtataacttcgtccttttcgtccagtaccacaagtccatgcatctgtccgccaaaactgataccagcaatctgctgcttgtcacaatcggcagtcaattccctgattccctcaacagtctgcgcataccaatcctgcggattctgctctgaccagccggggtgtggaaaaaacaggggatattctttagaaacgatattctggatcttaccgttttcatccatcagcagaagctttactgctgaagtacctaaatctacacctatatataacataataacctccgcatcattccaaaaagtcgggcaagggggtcagacccctctgcagaggggtctgacccccttgcccaccgttttcagaatattctgtttatttccagggattttccgtcggataccgtacgccggccggctggttatacccaatttcttccaccggcactcctatgtatttgaatacctcaaaaagcgcctttccataattgccaaatgccactgcgccatgatgcgggtagttgccctcaattaatacatggcggtagaaccttcccatctccggaattgcgaagatgccaattgctccaaaggagcgggttgcaacagggagtacttctccctgggctatgtatgcgcgcagcttacaatccgctgtgctctgcagtctaaagaatgtaatgtctcccggtacaatatcgccttcgagcgttccctgtgtcacttcttccggcagcgctctagccatgatcatctggtatttcatctcacagaaggaaagcttgctggatgcggtgtttccacagtggaagcccataaatgtatctttgtgcgtgtagttgtatttgccctcaatctcctctttgtacatatctgccggtactgtattgttgatatccagcagggtaacggcatcttcgcttactacggttccgataaattcactcaaagccccataaatgtcaacttcgcaggacaccggaattccctgtccggtcaaacggctgtttacataacatggaacaaagccaaactgggtttggaacgccggccagcattttcctgcaattgccacatattttctgtaacctttgtgctcctccacccaatccttcagggtgatctcatactgcgctaactttgcaaggatctccggctttttgttccctgcaccgagttcttcttccatctcttttacaatagccggaattctctcgtcccctgcatgtttgttatatgcttcaaataagtccagttcagaattttcttctatctcaacacccagattgtaaagctgcttaatgggtgcgttgcacgcaaggaaattaagcggacgaggcccaaagctgataatctttaaatcattgagcgctgtaacagcccttgcgattggcctgaattcatagatcatatctgcacattcttctgccgtgccaaccgggtattccggaatataggctttaatattgcgcagtttcaggttgtaactggcattgagcatgccgcagtaggcatccccgcgcccctgcacaaggttgtctccacgctcctctgccgctgcaataaacatcttcggcccgtcaaagtgctttgcaagcaatgtctctgcaatctccggtccaaagttaccaagataaacaacaagcgcattacatccggctttcttcacatcttccagcgcctgcaccatatggagttcgctctctacgatacagaccgggcactcatagattccctcttcaccgtatttctcatgataagccttcatcagcgcttcgcgcctgcttaccgacaaactctccgggaaacagtccctgctgacagctacaactccaattttcagttccggcatgttattcattgtatgtaccttcctttcttaataaatatattagtttcctattaccgctcaaactcagattccatttattccaatgtaatattttcacccttcagcccgcagaaagcaccctcgatctttgcctcctcatgggcaatcagccacttatttcttgcggtgatcagacagtcctcgccctccgtgcccggagtaaatgtcagatccgtattggtgccctccggcagaattacaacacatctgaatcctcccggctgtgcggtgcaaggcgcatagtgcagcgtggtcgcatacatctccacaaccgttcccgcaggcacataaaacgcctccaccttcgaagtatcatacgtaaaatccgtccccacgtcctgctgggaaccgagcagcagaatcatatcggtcaccgcaatattaatctcagatgaacggtggtactccagtccgttcagcttatgattatctccattacagtatccgatttcgatcggaagtcccccaaatgcccggtttttaaaggcttccgcttccggcagggcctccatctcttctacagatgctacgtaaatcacttctttcggcagaggcgtgtgctccatctccttcagaattctgcagatagaatagccctgcagcactcttccgtatttgccaaacgaagaatccgttactttttgaatatccattaatatccctcctaagaatgaaaatttattcatatttatccttatgaggtaattttatcagcttattctgtacttttcgaccaaatatttatctaatcaatggcacttttttgtcttttttctaaattcacttggcagcatcccgtactttttgcgaaatgccttggccaaagccttgctgttcggaaatccatgatccagtgcgatctcactgatcgtccgttccgtatttgccagttcctggtatgcgtactccacccgtatactctgcagataagtcagataattaattccggcatacttctgaaacatcctggagagataagcaggagaatagccaaagatctccgccagccggtccagcgaaatctcttccgtataatgctccttcacataggacgtaatgacagacagcctgttcagtttacgatttttccttaccatctcccggctcacttccatctcccggtacctggttaccagcaggtacaaaagctcataaaacagcccctgtaccttcaggtcatatccacactttttctcggtataagcccgataaatggaagaaatcaggatcatcaccttctcatcctgggattttgaatcatgggtaaaacgaatgaactgctctcctgtatagtatttctcaaaaaccttcagcggaatctgtacgacaaccgtcatattttgctccggagaatccacggaatggatctcattggaatttaccagcataaattcacccggtctgagaggatacttttcctcatttatataaaaagagagctctccctcaaatactgcaaatatttccaccgagcggtgccaatgcttatcacggaaataattgccttccctgccctcaaagacaaacaccttaaaaggtaaatcttcattcggcacaatcaactcatggctgaattccatatcgccgcctcctttactgattcctttccggattaacattccacgtctctcatattccgtttgcgtaaggggtaatgataatcgtccaaagggaaatgtagcgctgccctgattatagtatgtttcgggtgattttgtaaacaccggcagaaaggcttaccaatatttattatttataaaacggtttattttttcaaactgcatttatcaaattttcgcagtaaactgtctgcaaatcccaagaagactcccaccaccacaaacagagtcccaaggaataataatatgatccctgtcactaacttccccaatatctccactgccttttgttttatcatagacggcctcctgtctgataaaaaaactctttgcacctaattacacttttattctatcacagagaatttgtgaaagccttgcataagtctttcaatcagacggcttaaccttacgtttttgcaagatatagctcccggtctaaactcaaacatacaagcgcgctgcctcaccggggacggtcccttttgcagaggggtctgacccctttgcttcacccctggcctccgcaagcatacaccctgctgttgctgcattgtttgacagactccccccggaagattataatgtttgtattacacacgtaagaattaagggaggaacgaacatgacggtactgcctcagatttcagaagcagaatttgaagtaatgaaggtcgtatggaagcgtgcaccggtcagtacaaatgaagtgaccgactatttaacagcccataccacctggagccccaaaacaatacagactctgctgaaacgcctggtgaataaaggtgcactcacttttgagaaaaggggcagggtatttatctataccccgcttgtaatggaagaagagtatatcggccagaaaagttcttcttttttagagcgttactttcatggggatattaccgccatggtatcttcttatctggagcacgataaattaaccgaatccgatatcgaagccctgcgcagcctgcttgcaggccaatgcaaagagggaggaaagtagtgtgaccggttttggcatccgattttttatctgtaactcttttattgctttctttatatgtatcatgctcgccgcgaagcggcttctcaaaaatcatatttctgcccgcatgcagtacaacctctggtttcttctgcaggcattgtttgccgtaccctttctgcccccgattccctttgggtttaagcagatcctttccctgctgggatctggctccccctctatactttccgggggccgcattgatgctgctgatgcagaaaatgcagtgtccacagcaaccggttggatgaatgatttcgccatgtctgtttcccacaaaaggggggctgttattgccggaactctctccgccgtctggtttgccggaatgctggctatggctctatattttattcactcccgattacttctccgccgtttggaacgttctgcacttttgctccaaaataaaaatgtcctcacactctatcacggctgcgtaaacgaaatgcatttgaaaaaggctctcccgatctacagcaccccatacctgagttccccgattaccacaggtctgatccacccccgcatatatcttcccctttatctgatctcagattttcgcagcggcacgataagcgggaaagaactgcgctttatgcttctgcatgagttacagcaccaccggcacagagatgccctggcaaatcattttatgaatctttcaaaactcgtatactggtttaaccccctggtctggtatgcaatgaaaaaaatgcagtgtgaccgggagatcgcctgcgacgccgctgttctgcagatgctcgctaaggaggagtatacagaatatggaatcaccctcatcaacctcgccgcaagactttcttgtgctccgccttcttattccgcccccatggcagaaaacaaaagacaaattacaagaagaattctgcacatcgctgattaccgccctcagtccaggtccgctaaaatcaaagggattttgctatgcctgcttccgaccgtcgttttactgggcctctctcccatcttatctatcagggcggacgtacaggattatgattccttccagaataccagagaaaccacagaatatatagatctcgaatcctattttcagggatatgatggcagttttgtattgtttgacaccggaacaaatatctggcaggtctacaatcaggaaatggcttcgcgcagagtctctcccaactctacgtataaaatattcgatgcactccttggactggaaaccgggatcatcacgcccgggcatacgcatatgggctgggacggaaccaaatggccttttgacgcatggaatgcagaccagaacctgaattctgctatgcagaactccgttaactggtattttcaatcgatcgaccgacaggccggtcagtctgcggtcaaagacttttttcggcgaatcggatatggcaatcaggatgtgagcggagggacggactcttactggatggaatcgtcactcaaaatatcgcccgttgagcaagtatctcttttgaaaaaattatattacaatgactttggattccattcagaaaatatacaggcggtgaaaaatgcgatgtttcttgcatccaaaggcagcacctcactttatggaaaaaccgggaccggagctgtggacggttgggaaataaacggatggtttacaggatttgtcagccaagatgcccatgtgtttttcttcgccgttcagattcaaaatgaaaaaaatgcatccggcagtaaggcggccgaaatcgctttggatgtgctggaggaaatgggaaagtattaagaaaaagagaccctttggcacaccactttgcgtagctaagtggtgtgtgttatacgctctgtcggcgctgtaagcaccgtttgtcttgatcgttgactggctcggctggttttgctgtttccccagttatgcaagtgcggattatccccaagaaggcatacataacatttacatcggttttagatttctattgagccgatccaccatccagacaactcgcttttcccgtccggcatctgtctttgcgtcaaaatatgcccgcgtgtaggttttcttaactgataaggacatcgcctgaaaatttgcataggcgggctcgtacacttttagcaaatcagataaaaaggcgatctgttcctctggcaccgtcggggatttgggggcatcccattgtccgttctctttagcttcctctattttcttcctgccccagccggtcataagtccttgttcttcaaggcctttaaccaacgccttattcttctccgaccatttactgtccttcctgcgtaaagaaaaatatttcttgtatgttttgtcatcaatgctttgcatctgtccgtctatccatccaaagcaaagggcttcttcaagcgcttcgcttgcctttattgttttcggccctcccgcttttccaaatagaagccaaacgccagcatttgacaggcaatggtcagaaagccattgcctgaattcttctctgtctgcaaattccattacgtcactcattatgtgctcctcctttcgtacgccttctatggcctccttgtcagtttactgtttctttcattctaccacaaatccgagagactggatatcttatgtttttcagcgggatatccaaccttttggatatgcggaacgggcggggctggagaacagtccaaggctgtgaggctggggatattgatttgtctgacatataatggaagtggttttctttctttgaattgtttataataagaatggtacgtaatacgtgtgggaggataagtgatgttgaaatttatggtattgatcgccgctttgatttgctcggttgtttatatgacacttttttggatttctaatccgagggcgaatagaattgctcagaaaattcaaaagccttttgtgattaccagtgcactgcttcttgtgctgtatattttactctaatggctttcgcagctgagccttttgttcctgcacaggatatgcagggacggaaggctttttttgcacgctaacagaatgcgtgggggttaattttctgcagtgaggagcttctgcaataacatgtagagttcctcttcggtctttacgctgtagtcagggctcacacttccggtctgctgattgtggcttctgcgcctgatccagatggtatgaaggccggcgttttgggcgccttctatgtcgtttatataggagtcccctacaaaccacacattttcccgggcgatacccattcgttcacaggctttacagaaaatgcgcttgtccggtttgtccattcccatttcttccgatataaagatgtactgatcgggaatccattgcctgatagcaagctgctctattttgggcctctgatggtcgactgtaccatttgttataattcccagcggaactttttctctacaaaaagacagaatttccttcatcttgtcggatatacggactttcatctgataccctgcataccggcgctggaactcccgggcctgctctgccgggatctctatttgaagctcctggaaggccttctgtattctataaatgcataattcatccatggtaatcccgccgcactgcagacgttcaaaggctttatcgctgtattttcggcttaaagaaaataaatgatccacggaaatcgtgtatgtccctgcaaacatatccttatatgccagagcaaagggatccagatgatcgtacagcgtgtcatccatatcaaacaaaagcgcatccatattctttttcctccataatctatatgatgtaaatcacattataacctgtaaaagctgtttcgtctatgtagtaatccgtgttaaggatcaactgtaccgggatgtgtatttttttataagtatcaaatatatacagaaatttctgagcagataaaaggactgactccctttatacctaaacggaattcagccctataaaattatgataaattactttgtgtaaccaggccggcgtctctgccgaaagcactgctgctccccgaatcatccggattatcactgacaggaactgctctccttgtcaaatacaacctccccatccacgatggtatataaagtctgcgtaaatacctccataggatttccgtcaaataccgcaatatccgcatcctttcctggctcaagactgcctacccggtcatctgtacggcagatttgcgccggatttatggtcagcgctttcagcccttcttccatgggcagcccgtattttacagaataccccgcacaaataggaagatattggatcaaagcaaccgggtgatcagttgtcaccgcaatcttcacacctgcgtcagcaagaaccccggctgttttaaagctcatatactctacttctaccttggaccgtgaagtcagatccgtccctacaatcgccggatagcccgacgctgcgatctcttccgcgatcagatggccgtcggtacaatgatctatagtgatatccacatcaaactccttcgcaatccgtattgcggtaaagatgtcgtctgccctgtgtgcgtgggcctttagggggatttccttcttcaacacgggaatccacggctctagatcgaaatcctgttcctccagatttccgctctcccgtttttccagatacttcctggcatcaaacagcgccttcctcagcatataggctgttcccatccttgtagatggacacgtattctgttccccgtaagttgtctttgggttttccccgaatgctaccttcatagctgccgggcttttgacaatcatatcatccacacagcgcccatgtgtcttcataaatacaaactgaccgcccacaacattcgcgctgcccggcccagccataactgaggtaattcccgcctgaatcgcatcgtgaaatgccggatccatgggattcaccgcatccagcccgcggattgccgggaggacaggattcgtcatctcattgcagtcatccccgatggtcccgctcttctcttccgtgaggcctatatgcgcgtgtgcttcgatcagaccgggaagtacccatgcgccatgtacatccagtaccgcttcctcatattcctcctctgcagtattccctccctctttatccgaaattgtccgtcgcgtcccgccggataaagaagacaggcttctcttaccggaagaagtttcttcctccctcaggcctcccagatccggcagccctagttcagccgcctgctccatgggccccactgcatcgatgattttccccttgattcttacatatccattttcatacaccttccctgccatggtatagatttttccgttaatgatccacataaaaaagcccccttctccaaatacgatttcagatacgtttcgctttaaaaacatattcctataaagtatttccgaagagagcttatttattctgtatctataactatatgaccgatccggtatacgcaggtatcagacacttgttaccgaaatattaatacactgatgtactagggaatttccaggtctgctgcaaattgtttcacggtctgctgtacttctatgatctctttttctgtgattccgtccgtgtgaaaaccaccgctgcacaccgttactgcattctttttccggcatacctcttccgccacatagcggcagataatgtcgtctttatgccccgtcacattcagtgtggaggatgtaacgctgatgctcccatctccgctcagagagggtctgggtatggagagaaccgtacatccgatatgcggcttgtcaccgccctgcatgatgatataataatcctctcccagtcgtttcacttgaatttttaacgttgcaaatgacagtataattgtccattccatcttacatactcctatgtatctattttatttcccacggtacagtccaggccggtcttaactgttacgttcccataccatatctgcgtgtttaaatagtccgtaatttaagaaacaagcggcattatatacgtcacccatagataggacaacggcattacaataatcatcgcgggtatcatatctgctgttgggaacttctttatatttaccatgcggaaaccggttgccagcatcagaaatccgccgcaagccttgaagtcattaatcatcgccggtgtagtcagcgggaagatgatggttgctccgaaaaacagtaaagcgaagattataaactgcggcactgcgatcagggatactaccgcccccagattgcatgcaaaaatagctgctgtaaataagtccagaattgatttggagatcaaaatggagtggtctccgctcattcctgccacgatagatccatagatacctgtaccacttgcacaaaacagtacaataattgtaatgagggtactcatgaattcttcttccggcaatgagctgttggaaccttttacgaatttactgatcaccttctgcataccagctgcacctttattgatgccggcgccaagatggatgacaagtccaagccctgtcccgattacaatcgcaaagattacagcgggcatattttccattaatccgatagtgctgattcccattcccatggaacacactccgaataccatcgtaatctgtgctttaaattctgctgacagttttttgctcagtaccgttcctaatactccgccgattacgacggacaatgcatttataattactcctattggcatgtcacttactcctcttcctctcaaatttgcaggactgcaccgattttattacagcctgttgtctttctgtaaaggttaatgttataatgttatagtccattccatcttcgaaatttcctggcatctattccaaatggctctaccagttttgctgcagtgtgatagatcatctcgtctatattttccggcctgtgatagaaggtcatcattggcgggataatccgaactccctgcatcatagaaagttcgtaaagatttctcagatggatcgggcttaagggggtctctcttgccgccagcaccagaggcctctgctcctttattgttacgtctgctgcccgaagaatcagattatctgcatacccgccgtgaattccggctattgtcttcatactgcagggtacaatgagcatcccctctgtacggaaggacccactcgcaggagcggctccgatctcggtcatgttcaggacatgatccgcactttggcatatttcttccaccgtataagaagtctcctgcttcagcgttatttttgccgaatcactcatgatcagataagattcgtaatcttcggcttcccgaattaattccaggcaagtatgcagtataggaagtccgcttgcccctgtggctcctattataatcctcttcttttccatagcttatatcctcagtctttcacccaatgtgttggatcaacatccataaactgtgctctcttaaatctttctttttggtcaaacggcacggtgcagtcaaagattgtcttgcaggcgattccgcggtttttgatactcggtgagcatgcaggatcatttgatggatccagcggatggcatcttacgcccgggatggtaataatatctacatctccctggaatctggtgttcatggcccagagcacatcattgatatcaaagcagtccacatcctcatctacgaggaagatatgcttcaattcactaaatgcagtaaatgcaaccaatgctgcctgtctctgtcttccttcatcacttgcaacagtctttttaaactgcattaccgccatatattttccaccgcctgcagatgcacagtacacgttctggagtttgccaggcattgctttttctaccattccgtaaatacttgcttctgttggaatgccggccatagatacgtgctcttcgcttggtccgatacaggtctgcatgattggcttctctctgtgagtcactgctgttaccttgattgtccagcactgatcacatgccggtcctgtatatcccgggaactcaggcattgcatagcctgtatggctgttctggtcttcctttacacgtacattcggaaggatctcgccttcaattacgtactctgcattagcgattgctttctcatttacagtcaggcactggcacagttctacaggttctcctctcagtgctccggctactgccagttcgtcatatcccattggtgttgtaggcgcctcgaagcaggaaccaatttcaatggccggatctacacctatgctgatggagataggaagtttctgtcccagttcctctgcgcgctctgccatagccccgatgtgacgcgcaccaggtgtaaagaaaatagagagttcatcttttccctgaatgcagaggcggtgaatggtaacatcactcagtcctgtctccggatgagttgcatagcacataccaagtgtgatgtaaggacccgcatctacaggtgtgtttgttggagccggaacaagtttaaaaagatcaaaatcaggatcttctgctttatgtactacctgctggcataacggtgcatcttttacaagaaccggcggaatcggattgtctacgcttttgtataacatcttgccaacctcttccggtttgcatccgaacagtgctgccactctcttacggcttgccataactccgattgccacccgtgcatcaggatggcctttgatgttgttaaagatcatcgcaggaccttcttttgtcggacgcattaccgtaccgcctgctcctacatgacggtatactcctgacaattctgccatcggctcaacaggtacatccgtctcaatcaactgtccgggcatttccctcaacaattccaacgcgcttctgagatccactacttttttctccatttcattctctcctttgcttttatattgcttttagattgattttattttaatgctatttatctggtggatcaattcaacttgtgttataattcattccagaatggaatgaatcaaaggagagatcatatgacatttgaacaattggattattttattgagattgtaaaacacaaaactttctttgatgcggccgaatccttacatatctctcaatcttcactttccaaacagattataaagcttgaaaaagaattggacgtgcagctttttgaccgaagtaaaagaactgcacatctgacggatgcgggccagtttttctataaaaactcactgccgctcgcctcccagtaccaccaactgatgaaacagctgaaaacctatcagcaatctaagcagctcaaactccacatagggatactgccgattctgaaccagtaccagtttatcccccgatttcgggaattttccaagctccatccggatattatgatcaatcttagcgagctggaggaaaacgagcttttggaaggccttgccatggggaaatacgatgtgattattgcaagagaaggccttgccgatacaaagctgcaccgcacctgggaggttgcacaggatgagcttgtcgttgtattgccttccggccacccgcttgccaataaacaggagcttaccatccaggaatgcagccaggagtcctttatcctgatgaacccctacactaccgttcaccaactctgtctccggctgttccataaaaacaaaatcaatcctgaaatactgcgcaccgggagggttgaatccatcatcagctcaatctcaatcggtgatggtatcagcctgctgccaaagaaaaactttcagaccttccacagtgagaatatagcagtgatccctttggtcccaaaagtgaaccttcccgtctgctgcataaaaaataaagccgaagagatcactccggctttaaaagagtttattttatatttgcggctcatgcattaaaatgatattatctttaaaatattgagtaaccaggaaagcgtttaacccatgccgcctcactcttacgcacaaagcgccttcagcacactgctgaaagcgctttttcttttaccttggagttttgtattgtcaaaactactgaaacatttcgtcaccgcttttatatccgaaagccggatggcagtcaaattttactgctcccaccgcaatatccgggccaaccgcttttttaactctggcaacgccttcgtagccaaaccctgcacataattcaattgctttacagcccttgtccaccatttctttggccgcgatttctgcttcatcatagttttcaacacccaccacattcaaattgagctccgcacatgggataactacctttttcatctcttcattcacgccatcggctacatagataaatgcacattcaaacattggaaatctcctttcttaatgtatatgctgaagtatgtacaaacgcacactgtaaagcatgctctgtgggcaggttttcagcaaagcggaaaaataaggggtcaaaacacttcagcatatggttgatttgtttcactgatttataaaactatcatagtcttttacctgccggatgtcaatcagccttacattcgattttatctatgatgttactgtctggtaagtctttctttaccggaaagcaaaaaagcctcggaaatcttgaatttccgggctttttccagaggcacagaccggatttgaaccggtgatcagggtgttgcagacccacgccttaccgcttggctactgcgccttagtatgactcctacgggaatcgaacccgtgttaccgccgtgaaagggcgatgtcttaaccgcttgaccaaggagccataatataatctataagtgccaccgcttttgcagtgaccgttgtctatattaccataactcgcctcaaaaatcaagccttttactaatttttatttataaactgcagccaaactgtatcccttcagacgggtctgcgcatttgctgcgcagacctgcaaaacaccttcaccgccagtagaaattctacttcatccagtaccccacaattaagtccaccatccggtcatagctttctactccgtcttcctgtccgtttgccttgagatatgtatcgtttactttattcgacacttctgccactgccccgtcatactttgcccagaaccggctgttggcctggagatcggcctccactctctcatcgagcgccgcccttacctcctgccatgcttctgcatccgcacgtcgcagggcattcatactatagatccagcccatcaggtatccgctgtactgaaagtctccgcgttctgcatccttgcacgcaagaaatgcgataaagttggcttcttcctcctgcataaatccacgcagatgtgacagttcatggcaggccgtaaacggaatattgtaggcagtcatgtctttgttataattcgcctccacagtaaatggaacataaacaccggtcagaccctgataggaaaggatctctgatacaagaagccctttcggtcttggataatatccctcaagcgcgggatactgtctgcccagcgcctgcatggcattcaccgcgtctttttcctccgcgcactccagcatcatcaccccgttctcatcccgtttcacctgaccggcccttgtatttacttcctctgtcagccacaggcaggcctgtttgaggtcttccaccgtatatgcagtcgtctcaatgcccgatttttcagagaatgaaacccgtctgtaattaataccgcagtttaccacgtataacaccattagaatagagaacgtcaaaaacagtccggaagcccaccttagcatgacagcgcccccgcttcctcttctggccgcttccacaaccgcgtggatcagggagcccactgtcaaaagcaccagaacatacaagcacaattcagccaatgagcaggaaaataaaccggaaaaccgtcccaccgcagacacaatcaccgaatagatatgggtggaataccattcagccatcctcagtgactgccctgaaagcacagtaagaagcgcgctcactaccagcataaagcagcctgtaagcatccttttttcagttgtaccaaactttcgttttctccgcgttcttcccatgcctgctgctcctctgcaattatgcttaatgtacgattgatggaaaaatatctgctatataaatcatactgtattcggaagcaaaagacaagtttagacttgtgaaaggaggtggatacgaaatgaaaaggtaggtgcaggcgtcccgcagttacggcacacgccccaaaggtgtgaaaagcagcagcctgtcccgcagttatgagattcatcttgtcgttatctaataaattaagtataataaaagtagatagagagcataaacctaaaataatagaaaggagctgtaaattatgtcaaagaatgtaatgatcacgataggcagggaattcggaagcggtgggcgtgaaataggagcgcggcttgcagagcggttgaatctaccattatacgataaaaaccttgttgaacttgcagctgaaaaaataggtatcagcgaagagagggctaataccgttgatgaaactgcattgaacggttttttaacaacatacgcatatccgccgggaactatgatggactatgttggacgagtagattaccaacagcctttgactgacaagatgttctacgtacagtgtaatttgattcgcggtctggctcagaagggaccggctgtatttattggaagatgtgcggattatgtgctgcgggaacaggaggaatgcctgaatgttttcatctgtgcagacaaggcagacagggtaaagagaacgatggaactctacggactgactgaacggaaggccgccgataagatgaaaaagatcgacagagaacgccgttattactatgagacatataccggaaatgaatgggatgctgtaagtactcatgatatgatcctgaacataagcaaactaggaatggaccgggcagtcaggtatctggaactgatttacaagggaatggccgaagaataggaagctattaaaaacacatatgacggcccaaagatgtaacatccggccatattcacatactcccgggtcactataaaaattcatggaaaggaattatcaatcatgtctgaagaaaaaacatttccctgcataccggacgaatcccagctaaaagaaattggtatctacgagtatggttttatatcaaccgccgacatcctgtttcaggatgaagtccgccggatctgccagtcaaacggctgcggccaatacggaaaatcctgggcctgtccccctgccgtaggcaccgtcagcgaatgcaaagcccgatgtctggcattcgaaaacggcatggtattcaccggaaaatacgacctggaagattccttcgatgtagaaggaatgcaggaaggccacaaagaattccaacaagtatccgcgagactgcgcggactccttggcagcagattcccctacctcctgctctccaacgagggctgtatccactgcgagacctgcacataccccgacgccccctgccgcatgcccggaaccctcacacctgccgtagaaggcttcggaatcaatgtccagcgcctctccaaaacagccaaagtccgctacataaacggccccaacacagtaacctacttcggcctcctgctattttaacccccctgcgcccacccaaaacacatctcatccctcatccgctgcccccggaagcgcccaccacatggttatcttccgcctggatgcaccaagcctgtatggaatgtgcctcctgccgcagcccgggaaacttccatgccgctttctgggagcatagagagcgtcatactctcacttgataaaaaccgcacccgattgagaggctaaactctgctttaccaagcagagtttaagccggcctgagccgcgcaattcatcagaattgcggggtgaatgccggtggtgcctcccaatcgggtgcggtttttatctagtgagagtaggcaaacggcccgcccccagaaagcggcatggaagttttccgggctgcggcaggaggcacattccatacaggcgccctccctccgcccaaacacctaaaggtcgtccacaagcgcgctgctcttagcataagccgtgctccgagcctcgaagaagtctgtctttatcatattagcattcgaaaactggctgacccaggacatgctttccggttctttctcatgcccttcgtaaatgggatccagctccagacctctacatctcaggttcccaagatactggatataatccgtgatcatatcctggttcagcccctgtatatcatccccgatcacataatgcccccagcggatctcctgctcgcagccctcccggatcatactacggtagatttttgctttctccggtgtaaacagccatgcctcctcttttttcagctccattaaaatattacggaacagccacagatgggtgttctcatccctgttaatatatcggatctcctgcacagatcccggcatcctcctgttccttccaagattatagaaaaacataaatccgctgtaaaaatacacaccctccagaatataattggcaatcagcgtacgtgccagcatgtccgggcttttttcctcctggaatgcattataaaggttcccgatgaactcatttctttccaatagatgccggtcctctttccactgatagagtacggcattgcgttcctgcggttcacaaatcgtgtccagcatataactatagctctggctgtgcaccgcctcctgaaatgtctggatagacagacacaggtttacctcatttgcggtaatgtattccccgatattcggcagattcgcagtctggatactgtctagaaatatcaggaatgacaggatcttatcataagccctgcgctctgcagcaggaagcattttataatccttgatgtcaacgctcagattgatttcctccggcacccagaaattattcatagcctgacggtaccagtcgctgacccatttatacttcatatgattaaaatcattcagattggtcgtgttccccccaatcatttttcgttttgtaacttcaatatccccctccggattaaagagtggtttcttaactagttctgacatgtcagcctcctgttttcaacattgtcttaagaagagcatacctcacattcctcaacttcaaggcttctggagcgaatatagtaaatcgtcttcaccccttcttcccatgcctgcagatacagattcaaaactccgcggaaggtgtactcattcgtaatataaaggttcatactctgtgcctggtcaatatgcctctgccggatgccgcaggcccgcacagaccatgactggtcaattaaatgtgcatttttataataccagaatgtctccatcgagagttccggtgcgactctcggcatcagcccatttttcttctcctccataaaatacctgttcatcacaggatccagacccgccgtcgtcccggctataatgctggtgctgctggttggtgccgccgccagaagatagccgtttctcagtccctgtgcagccaccctgtctgcaagcttcttccacctttcatccatcagatttctctgccggaaatacgcccctgtctgccactcacttccctcaaagtaggcgtaactgcctttttcctttgcaatattgctgctggcgtctaatgcagcatagtggatatccgcaaaaaccttctctgcaaagtccagatgttcctggctttcccagcgaatcccatgctttgcaagcatatgctggtatccgcttacgcccagaccaatcggacgatatctgtggttattaatcctggcataaggcacaggaaagaaattcaggtcaatcacgttatccaaagcacgtacggcgctctcggtaatgtaagacaattccttgtagtcctccacctgtatatgtcccaatgacaggctggcaagattgcacactacaaactcgcctggttttgtcaccgtcacgacaacggtctccccgtctacctcctcggtcctctgctcttccaactctatcgcgctcatattctgggcgatctctgtacataggttgctgcagtaaatcatacctttatgccggttaggattggccctgttcaccgtatcccggttaaaagcaaagggcgtcccggtctccaccgcactgcggataatcagccgaagcacatctttcatcggtatgacccgcttgcggatccgttcatcccgcacacagtccaggtacttttcctcccactcctccccaaaagcatcttccagggcatatcctttaatcgtcagtatctcatgggggcacataagataccagtcgctgtctatatgatcccgtgcctgcttccaaaaataatccggatagcagactgcgggaaatacatcgtgagccttcatccgctcatcgccgttattcgtccttaaattcaaaaattccggcaggtctctgtgccacacatccagataaaccgccacggccccctgccggaccccgagctggtccaccgccacagccgtgtcattggcgagccgtatccagcggatcacaccgcctgcagcgccctcaaatccacggatagagctgccgcttgcccggaccttgccaaaatacatgcccatcccaccgccgtatttactgaccttagcaaagttatcaatgctgcggtagattccatccagactgtccggcactgtgtcgataaaacaggaggacaattggtggtacggctttctcgcattagaaagcgtcggcgttgccatagtcactttcagcgtgctgagcatatcgtagaaacgtctgacccagatgcttctgtcttttttctcctgcatcgccagatgcattgcaattcccatgaacatttcctggggcgcctccagcggttcccccgtcctgctgcagatcgtatatctcccaagcagcagctccagactggaaaatgtaaacagatcattccttttcttacaaagccatgtctcaaactccccgatctcttcctgggaatagttctctaatatatattttccataaagcccctgttccgtaagccagcatattttttcataaaagctgtggatatgaaatgcctgcatctgcctgtccagctgaagatcaaaactgagcattctgatcctggcagcaatcatctcccactttggcgcctcctgtgtcgtcagctccgcacatgcttttacgagtacagccagtttttccagatccgtcagcccagggcttaaaagcgcctgaaatctggcattcagctgctccagctcgtattcctcctggataaattccttctgaatgccggccaatacgcctgaaaccccgggtatactttctaattctgctgcaatccgctggcgggatatccttcgtcttgcccttccctcccggtacaggatatagctcttcagctccttataataattctcctccatcagagtccgttcaacaaaatcctggatttcctccacagatatggcccgttctcctgcatttacatcgtccggaaacttcgactcaattctgtccagaagcctgttgctttctgattccgcaatagaactgcccacactggaaaaggcacgccctatcgcatttttaattttctccgggtcatacacagccagagctgcatctctcttataaatcttcatagaattctcaagcctttcacaccatatattttcacatacttgcacaatctattgtgccatgtagaacatattaccacaacatatcgttgttatcaatatacagattcttacattgtgagacgaatagtagcagttcaggcaagcctgaactgttacggcgaatgttttaatccacgttcggttatttcacagagtaccacatatcttgaaattagtcttcttgctgaaggtaaattctattcggaatacataagattttactttgatatcatctataaaccaaaaatactcccagtcaggaagacagatcaattaatattctgatccgtctgcccggccgggagcagttttttatctctcaccctcgcagaacatgaattacaagatgccctggagcgtgtctgaagcatccttttatttcaccagatacacatccgcctgattcacgcccatactgagagctctgtcatgatcatttacatagatatcaatatgattccctttcactgcacctccgcagtcctccgctgtgaatacatgtcccccaataataacctgcgtcccataaggaatcacactcggatccaccgcaatcgtctgtccttccacaaccggagttcctgttgctgtaatgcctgtctccacgtcacagcatacctcacaggaacagtaataagtcagctggtaatctcccagatactctccgtacatatcatctgtggcattcacttccccaatgctgctggcaaaaccgccgcccacactgtcatccaggactttcaccgcccacactgcctcggatgtatccacattcccctggacgattccataatctgatcccatggcctcaacggtctttccgtctcccgcatagatcacaacatggtgaatataaccgtcctttgcgtagaatatcagatctcccggctgtgcatcctccacggcaatctttgtgccatactgtgcctgatcctccgccactctcggcagattgtatccatactctttaaaaatactctgtacgaacccggagcagtctgcaccttctgtaaggctggttccgccccagacataaggattgccgataaactgtgaggcaaactctaaaacagactgtctgacactgctgcctggtacccctgattttacggaagtcaatgtgtaatagcaggccttgttcttttccggttctatgatctcgctggcagtcgggaagttttcttctcccttctcctccacagtcttattcacttcattccctgtcttaagatactttttatttacaaatcctctcacatcgcctgattcaatataaacccactcttcattctcgtcggcaagtacatagcacaggctgtctgccttcaacgttcctacaatcctggtattcgtgtctttgccttctctgacgttgagcagtccgatggttgtcagtgcatatttcttgtcaataacggtcctgttcaccgttgaatgtgtatgtaaaaacgcgttattctcattctggggaattaactccttcgcaacagaaaccacgctttctattccagtatactttgtctttgttctctcggcctttttcttcgccctgtcctgatactttgttaaaagcttctgtgcatcgtctccccgcagaacctcatccgctttcacgaaaccgcggaccgtgcctgattccacatacagccagccgtcctcctcttcctgaagtacatacagaagtccgtttgtattcaaagaaccaactgctctcgcattctctgtcatctcttcacgcacggataattttgctttcgcaaaagcataccttcttgccaccgtccagaaccggaagtccttcttaatttcgggaagcttaaaaatctgctgaccggcaatcaaggcctgattgttagaatggtcctgcgcagcaggtgcctcctgggcatctccggaattattgccctcattctccccatcactgccgctttcaccggaatccgatggtttctgtgtatctccgctctcctggtctgaaccgtcctggctgcctccggtatttccattgtcggaggtgccgccattctcttctttatccccgtcgtcttttccatcttcgtcatcgctgccaggcttgtccgttgtattaccgcccggtttatcagttgtattatctcccggtttatccggtgtattgtcacctggcttatccggtgtattatcccctggccggtcactcccgtcaccgcccggtttctcctcaggcttttcttccacccgctctcctgtaaccgggtctaccttctgatttgtcttactgtcatgtaaaaacttggtctcctcatcctgataaacggtgccgtcctccagcatcttgagcacctcttccgagatatccaccattgttccgcttccgtcaaccgccgctgcctgacgggcctcttcgggctgttcagtgtcatttggctgctctgtatcttccgactgcgcaccgtcctgtccctctccgccttcctgttcctgctgtaacggatcattcatgcctgtatcggctgccataacggatgccggctgtacagccatcattcctgccgacaagacaactgccagcattcttttgtactcttttgctttcattctaattattcctcccgcaaattcactgcaattctctataggtctcatacctctgcgtaatcatcattctcccggctatggcagcccccctaaaacttccaacgccgtccgcctgttaaggcagaaactcgcaaaaaagagctttgctctgtatcttccttgtatctatctcctatgagatcattattcttatattgtactccctggcgggaatgaatgcaatcatattttcccctcattactgtgcaatttttttatttcttctcggcattactgcttattcaattttggaatcatcatacgataaattggaataccctatttcctctaaattccataaactatattgacagttcgtacctgccccactataataaatttaattgaataacaaactatcttcagggcagggtgcaattccctaccggtggtacagcccacgagccgcaaggtatgattcggtgcaactccgaagccgacagtaaagtctggataaaagaagatgaaaagtaaacatgctttttatatactctgagatgattctatcatttcagagttttttgtttagatcgcataaattacctttttaaatgtcttggatagattttattcaaggcatttatttttttcggaggtgatgatatggataatttaaaacacatgcaatccgcattggcgcttgcaaaaaagggctgtgggtttgtgaatccgaatccaatggtcggggctgttattgtaaagaacggcaaggtgatcgggcagggctggcatgaatacttcggggggccgcatgctgaaagaaatgcccttcgtaactgtacggattccccggaaggggccgtcctgtacgtaaccctggagccctgctgccactacgggaaaactcccccctgcaccgaggccataatccgcagtggaatagcaaaagtggtgatcggcacgctggatcccaatccggtcatggcaggaaaaagtgttgagatcttacaaaacaatcagatccaggttgaggttggcgttctggaagaggactgcagaaaactgataaaggtattccgcaaattcataacaacaaaaaatccctttgtcctaatgaaatacgctatgacaatggatggaaaaatcgccacttacaccaaacgctcaaaatggataaccggcaaggaggccagacagcgggtgcatcagacaaggcatgctttttcagcaattatggtgggcgtgaatacggtcatatatgataatccatcgttaacctgccgtctggaaaatggcaggagtccggcccggatcatttgtgacacacacctgcggactcccctggaatcaaatgttgtccagacagccggttccgtcacaacctttctggctaccagcagcaaagatgaagggaaacggagacaatacctggaaaaaaactgcgcactgatagacgtgaaggaaatagacggccatatagaccttacagaccttatggctgacctgggcagccggaatattgacagtgttctcttagagggcggcagtactttaaactggagtgccttagaccaaaagatcgtggatgagacagagatttatatcgcccccaaacttttcggcggtgcagccagcactcctgtgggtggaaacggcgttgcttttccgaacgaagcttttcagctaaaaacgtcttctgtttctcagatcggggatgattttcttatcgaaagtgaggtgatatatccatgttcactggaatcatagaggaagttggaaatatttccggtatacataaaaaggggaattctgttcgattgattatctatgcaaaaacaatcctggaagatatcaaaaccggagacagtatcgctgtgaacggcatctgcctgactgccgctgctcatggggcatcctcgtttaccgcagatgtcatgcacgaaacgctaagcaggacggccctctccggcctgaagcagggaagtcccgttaatctggaaagagcaatgccggcaggcgggcggtttggcggacatatcgttacaggccatattgacggcacagggactatttctaaaattcaaaaggatacgattgctgtatggtacacaattcagacaaccgataaaatcgcgcggtacattattgaaaaaggttctattgcgatagacgggatcagtcttacggttgcagcggtatccggaaacagttttcgtgtctctgtgatcccccatactctggcacatacagcactaatcacaaaaaggaacggcgataccgtcaatcttgagaatgactgtatcggtaaatatgtggagaagcttctgggcaaagaagatacatctatgataacaaaagagtttctacttaaaaatggatattaggagggcattcaaaatgaagctggattcaataaaaaaagcggtcgaaacattacaggcaggaaaattaattctcgtcatggacgatgaagacagagaaaatgagggcgatcttatatgtgcagccgagtacgcaacaacagaaaatgttaactttatggcgagctttgcaaagggattaatttgcatgccaatgagcagagaaattgcagagcggcttatgctgccccctatggttgagaaaaattcagataaccacgatactgctttcacagtatccattgaccacaaagataccaccaccggcatttccgccggggaaagaggttttactgcccgcatgtgtgtatcagagcatgcctctgcagcagatttccgccgtcccggccatatgtttcctctaatagcaaaagagggcggaattttagcgagaaacggacacacagaggcaactgttgaccttatgcgtctggctggtttgaaagaatgcgggctttgctgcgaaatcatgagagacaacggggagatgatgagaacttctgagttgaaaaagttcgcggaaaaatacagtctgccatacattacaattaaagaattacaggagtatagaaaaacaaaagaagttttggtagaatgtgtctccgttacaagtatgcccacaaaatatggggatttcaccgcttactgttatgtcaacaagttaaccagggaacaccatatggccctggtaatgggcgatatatcaagcggaaatgacatattatgccgtgttcattcagagtgcctgactggtgatgtatttggctcgctgcgctgcgactgcgggcagcaattggatcaggcaatgagaatgattgcggaaaaaggaaccggcgtgctactgtatatgcggcaggaaggacggggaatcggcctagttaataaaatgaaggcatatcaattacaggagaatggattagataccatagatgccaaccttgcattaggattccagggagatcttagagaatattataccggggcacagattctgcgcgatttaggtattaaatccctaaatctgctgacaaacaatccggataaagtatatcagcttgaggattacggaatatccattacgaagcagcttccgatagaaatcgaggcaaccgaatatgaccggttctatttaaagacaaagcaaacacgtatgggacacacattaaacatcgaggagggaaaatcatatgggcataaataacataaaaacatatgaaggaaagttagtttctgaaaatattaaagtaggcattgtagcggcaagattcaacgagtttattacatccaggctgctggccggagcaatcgatggattaagacgcgaaaatgtaaaagaaaacgatatagaaattgcatgggtgcctggcgcttttgagattcccctgatcgcctcaaaaatggccaaaagtaaacggtatgacgccataatttgtttaggggcagtcatccggggaagcaccagccattatgattatgtatgcagcgaggtttcaaagggcatcgcacatgcaagcctggccagcgatattcccgtcatgtttggtgttcttacaactgatacaatcgaacaggcgatagaacgtgcaggtacaaaggctggcaataagggattcgaatgtgcgcagggagcaatcgaaatggtgaatttgatccgctctatggattagaattgtgcaaaaatgtccgtacagcaaaagtttatagctgtacggacatttaaccgcaaaatttatcgtatatctttcctttttattattttgaaataatctctcagctacgcctcatcctcactgttcttcatatattttatcatctgatcggccacattttccagatatgccctgtccatgatccgatatcctgagtctagtttttctatacatccactctcttcaaaacggtatagaatattatatattcctcttctgctaatccccagattttcacagatattatagatacttttatacttaaaaatatcgccgctggaatgcttcaatatataatgtgccaggatttcattctcgccgaaaaggcttctcgcgagaatatttttatacatcacatagacacgcttacttgttttctggtaaaacatcactaaaaactcatcattctgcatcaactcatccataagagactttttcaataccagcacttttgcatttgtctccgccacaccggagcattgaaaatccgcattatgaatactgctgatgggtcccacaaagttgtccgcatccaatatatcaacaatcagctttttgccattatatgagatgttttctactttaataagcccgtcaaaaatatagaacaaattgccagtttttcgttcagccctgaataaatattcccccttctttaactctaatattggaattaccggtaaataatctttaatatgttcatagatcatagtattcttgatcatgctgtgattatccaagtttttaatcccctcttctaaagcatgtactctatgacgtgtttcccctgatcctccaatgcttccctgtccttaatatatatgtaattatcatctttctctaaagttccgtcttttatcagatcattcaatgtgttatacaggctcctcctgctaaagcctaaaaactcgcacagcgcgttcatatttggacagaccattctgtcttttttagaatttgaaagaatgtagcttgctaatatctctttctggctgtacatgctgttcataagcatacgtttgtacatatgataaaccctttggctcatcttataatagaatgccttggcaaatcggacgtcatttaacaacttttcaaatatctcatcgttaaattccagtaacatcgtatcttttacagcccatgactcacaattcaaatattcttcatatacgtcgctcaaatcgccggcaaaccaatcctcaccgatttcatccacccagattttcctgctgcctacattgttccagactcttatttgaccgtttaatatgtaatatttgttcggtgtcccatcccgggatgaacgtcgtttcgtaatatactcacctttttttaccttaataaccggaatctgctccatgtaaccttcaatagaatcataaatggcgatttgttccaacttcataagctcactctcctttcactgtagttttacattatttcacataaacagaggtagtaaacttttcacactttttatcaatttgtacattttttgctaattaactgttaatttttcattaattttcacaatttttttctcaatagttaatgctttttccacttcatctatagaaccatatccctgcaggactgccatattcttcctgacaacatttgtcagattcagtcccttctgcacacattcttccagaaatgctgcgtataatataatagtattctcaccataggtagataattcacctttgagataagtttctatagaagttgtatacccattttcttctgaagtgtatgtaggccgcccctgtcccgcatatgcaggatatctgcgcttaaaatcttccgcccattggagctgtatatccgcaatgcgatcgatcaggcgccgctttttctccgaaatctttggaagcacgctttttagctcttcaaaccgctccggcatagtgtccttcatcataaacgcatatttttcaaacagcagattacgcccattcgcttttgccttcatcaaatccatataatagctgtctgtaatctcttttggccaggccataaactggcttttccgcataatataaaactcctgccagttatcctggcagtccgcacggcctccctcatttttcacaagctgaaactgacgccattcctctttgataatatcgtctatgcttaccataatatcatcctctcttatgatgccattacaggaagggaacgtatcgtatcgtccttaatacgatgccttgctgcataggcatgttcttccaggtaatcggatgagctgttgctgattccctgattcttcatttcctcgataacaagagcgcagatgtcttctatcataacgatcactttgtcgttcctgttcagctcaatctggtaggtattccattcgtttgtataccagctgcctctgttcggccccacatccacaagctttttcaggattgtcctgacttcagtcagcttatccattcctttcatccccttccacatccatttatagtaaggggtatattttttgttcaacagatacaccatggatatggctgcacgaataaattcagacaaggcaagaactgccgctacggtgtcgtgccttctcatcatcctgctgtaattgcactggcctgagtgcgccatggtaatcgcgcgggccgctatcttcttcagacggatatcttccggataatatcccagcagctgttcgcgtatacccgtaaattctcccagattatcctcaaacaccttaccgttggttgccactgccagataatgttccggtatgatcagccagtccggcagtttttctggaactcctcttgccccaaggaatttccggtagaatttatcaatctctaaaacgcctctgcgcccttccgcctcggtccggtgagtcttggcggagatcccgccgtactccttgggaagcgcgtcgtatatttcgctcatctcctctccaattacttcataatccttcttggtcagccaaatacagaagctaggtccgtaatcatgatccatggaaatcatatcgtcatatccaaagcactcggaaccttcgcccaccaggcccacggcgatcttatccatataagcaggaaataattcctctaatacaggccttccgatcgtttcataatattcctgggagagctccagccccttcttctcaagctgcagaccattactttgtaccattttccaatttcctcctgatcgcattgtagttttctacaagacgtttataatcggaattttccccataatgcttctttgtctctttcatagctttttcatacattgcaagagagccttccagatctttgcttaaatacgccgtatatgccttcatggcaagcacgccgcagtagtgcggactattatcgcattccttttcaaaaagctctacagcctgatccagataggactgcacacgctcaaaatccggctgttccaccctgagaaatgcacctgccaaattcccatatactgttgcccgttcgtctgctgaattcggtacctgttccagtacttttacggcttgttcaccatacttcacagcgtcctgaagtctgcctgcctccaatgatgctactgacatattattataaagaccgccaagacgatagtcaacttctaaattttcccgcttatatactttttctacctgaagataaagttccatggccttgtctacctgcccggacgcacggtagatatttgctatattcagataagtcgtcattcctgccagtgtctcatctagtttatgctgcataacaatctctaatgcctcataagcatattcccatgcctgatccaaatggctgatacttctgtaatatcccatcagctcgtttagtatggtaagctgtgatgcccaatcgctctccgaacgggccgtcttcagggagttttccagataatcacaggcctctttagattttccttttgcaaaaagctcgtctgatttttcaagtatcttttttatctccatatttccccttctttctaaaaaagcgatgaaatccggattcctcccaatctcaccgcttttactctccattaacgagtttgtcagatattaccccaaattgtccatctgacttctaacgttcttatactctgccagttcctgatcatttactttaatatgagtatataaccattcaatgactttcttattaacctgctcttcaaattcctttgtcgggccttctgctgcaagcttaactgcaagattctttacatcttctacaagtgctgcatgcatctctttgtgagcatcggtttttggatactgtacttcgtccatcagtttttcttcttcactgaaatggtaggttgtataatctgccaggaatcccaaagtctcctgcactttctccgtactatctccattttcaatgctttcaaataaatcgttggcacgtttgaacaattctttatgatgagcatcaatcatctcatcgccagtcaaaagacttggcgtaaataatgctttcattcccatttcctcctaaatataatttcataccgtaaatatatgttttaagcctttgcttctgccttttcttcacctgcatgaagccatccttcgatagacttagcaaaacgtttggacaggaattttacaacctggcctacgcagatcgctgcaataattgtaccctctcttactacaacgccttctccaacgaaagactgcagtcctccaaggaaaattaactgaagaatcaatgcgataacgatcatacttgtatcaacgattgtcttacaatctccaaatgtctttcctgtagcctgtgcaatagctcctgcaaggccttctgcaggcatcggcacccagtttggacgcagataaaggaatactccgataccaataataattacgctgaccaccatataaataaactgcataatataattagacggccttgggaagttaagcataaggtgccctatggccttcggatctgttccggttaaatctatcatccagctgaatacaaatgtcagcaggattcccagagcatttctaagtttaaaatccttccgtagaataacaagctgtgctactaccaaaaagatgtaaataataaatgtagttacacccagagtaaatccccaaatctgttctgttgctcttggaatagaacttaccggagagatacccagattggacatcttggatatattgataccaatcgtaataataagtaatccacctatataacatataatttgttttacgatatttcctggtttagaattagacattcctgcccctccatttcccttatgtgaattcgtgtcctttagaaaggtgtatcgtcaccaatataacatgcaattccattatccagatataaagtctgcagttctttcattctctcatctgtcatatccccgtggtctacgtattcatactgttttcccagctgttcccatttcgaggttcccatacgatggaatttcagaaggttgatttcaaaaagatccagcctcttcataaactcgatcaatttcattgcattttcatcactatcattataaccatggatcgtcggctggcgaagtaccagacgtccattccatggggattttaccaaagcctctatgttcgaaagaatcaattcatttccgacgcccgtcccccacttatgagcctccgtatccatattcttcacatcaataaaagcgaagttaatatttgttaaaatctttaaaaagttttcttccgttgcaaaaccgctcgtctcaattgccgtatgtatgtgtgacttcttacattccatcagcacatcatacagaaaatcgtgatgcataagcggatcgccgcctgtaaacgtaaccccgccttcggaaccccagttactgaaatcccgttttaatattttcatcaggccgtctactgtgtactctttcacacactgtttcaaggcattgttcggacaaatgcttatacactcaaagctctcgcagtcttcacaaatggaccatgttatgctaggtttcccattctcatcgaatttgatagagtccttggggcatgtatttctacatgccctgcaacccttatcatacttacatactttctctgcaaacattatatgtttttttcttttccagctttccggattggcacaccatctgcactcaagcggacagcctatgaaaaatacattcgtcctgcagcccggtccatcatgcacggaatagctttgaatatcgaaaattaatccattcttttccatatatgacttccttaattaattattttttattttttgtagttttcgcagctaaatgctccgcatgttgaataagcccagttctctttgcagaatcctttgcaggttccgattccgtatttatccggattttcgaaattctggcagtttccgcaagccggagctgcttcatacttcgggcaggcatcgcttccctcgccatcgatcggaacgatcacttttgaaagtgcacacatacctttttcgcagtcaagatttatataatttacacagttgttatgtttcatgattctacctccatctctctcttttttttacgcttcgtcgtattctgttctaaagataacctcatcctgaattgccttaccgatttcacaccagtactgtgtaaatccagcaacacgaaccatcaggtcacggtaagattctggtttcttctgagcagctctcagagtatcggaacctacgatgttgaactgtacgtggaatccacccttacgcatgtaagcacggataacatccagaagctttcttgttccggtcagtcccttaacagccgtcggatgaatctttaagttcatctgtgagttctggcacatagaatgatcatatactgtagctgattcaaatactgcgtacataccattcttatctgttcctggtgctgcagatgcagatgcgtctgaataagttgttcctgcaagtcttccgtctgctgttgccagtgtaatgaatccctgaggaccatgtgtggatacagaaatttggcacatatacaacggtttgccgtagtaagatctgattgtaggtatgtattctttcatacgcatttcgtaatctactaagaggtcatctacatatctttctgcattgccgtacttcggtgcatttacacatgctgcgaaaatcttttcatatttctcagcctgatctgtgctctctctgaagtcaggtgagaatacgcctgtctcataagctgtcttgaagccgaagttgttaatcattgcgtctgtcatttcttccagtgtgaatgctttgtcatcaaatacattcttcttaatagaagcaagcgcattgataaatgtaatagttccgcaagactcaaagttaattgttgcgttgtattttgctccacagtttccaatatgctgtccgtttgtgaagaagccgcccttaagcagagaagctactgccggcatattgtattttctccagatatccatctgcaggttgttaatcttgttaacgatctgattgctgagatccagatatttataccacagatctaccatcttctcgtaggaatcaatcttttcgttgtgaggcgggaatacctctttgcctgttcttgcatcaacaccgtttgtcagcacgagctcgagaatcttaggaagtgctgtaaagtggatacctgttccacatgtcggagaagctccgccaggaaccatcgtaactttaccattgtagttcaatggtgagaatgttccaggagatgactcaagacatccgccaaggcaccatgcccttgcttcaacaacgcccattccctctggtccatactgtctcatcatgaagttcatacctgtctggttgttcatccatgccggatatcccataccaagttttgtacagcgagcacacttcatcaggaagtcttcaggagttttctcatcatacagtacactcagtgtaggctgtggagtctgtgctctcataccagcttcaacgatcaggtactctaacggagtaactgctgtaagaccatcgtatcccaggccgcccattgacaggttgttgaatgtatttccggaaagaacaccaccggatacaccagctgatgcgaaacattcgatacatgtaatcttaattctgtataattcaagaagttcgatgatatcttcatctgttgcaactccatcctggatgtctttctcatagaatggctgcagaacctgtccgagacgtccgatagactgtcctgactgaggatcttcgtttacaacgccatagtgtaagcaaagtgtcatctgaagagcttcacggaatgtagctggagccttatgagcgatatttcccataacctctgcgatttcttcgtaattcttcttgaattccggatccggctcacgtgctgcaagatcttttgctttgtcagcatagttctggcaccatttgcttaaacctttacatacttctttcattgctgcgtaatagtatccacggctcatgccaagaacaccgtcatcgcctgcttcacccatgaactctgcgatcttctcatcacacagttccatgattccatcgaaaccatactgtaatggcaggtagtagttcataacttcacgtccctgaggaattgcgaaggaatcgaacataacaactactgaatccataactttctcgaactgatcatatccaggaagcatctttccgtattttgtactgatatcttctactgaaattccatcccagtattttgatacttttacaagtacaggaatatcttcttttctcataccaaacttcttagcaagagaaacgatctcgccgtaactttctgttacgttaccgccgccggcgccaacctgagaaacagcatctgctgaactctctgctggagcatcaacttcgttcataagagcttcagcctgagcattgaagaaacttgctgtaacccatgggaacgggaatgcaccacgaacgtttttacatttgttcattacgagtttttcccaaggaaggatagtcggtgttgtatgagcatatccgcctgcaaccgctttagctcttctaacctcaataaggtcaccatcgttctcccaccagattctgttgtaccagtatggagtttccatatctgctgatacctttaatgtgtaataaacttccattaattgtttaaaacgttcacatggttccggaatatcggcttctgtagcatcatcaactgccgccgtatcaataccccgctgttttaagatttcctgtactttactttcgtttgaattcatgttttttcctccttttcaatcttgaattcgttgttatagccatcttaactctcttttagggttaatcgttagtgcacattgcacacctttgaaaaattctaattttctttttgcatttctctcaacccctctgatttagcgcgttgcaagggtaaagcagtgaatttcgaaggcattttacgatatcggtcatttcagcactttaacctataaaaggaaggaaatctacctgggacaccagcaaagtttacaagtcctgtatcatgaagaaaaaggaaaggaatgccacaatacatgtgggattccttccccttttaacctgagcgcagaaaccgggacctcattccctttggtatgcttacgttctcacttttttaatatacctatttttcttctgccatttctgccttttcactggaatcagcagctaatactgcaggtatttcttccgctttctggtttcttaccgttttaccggctttttcactctcaatgttaggattcacattcaaatttacttttccttcctccatacagatgtatacatcatctcccggaaggatatcgcctgaaagcattctttctgccactacatcttctacttctgactggacagctctcttcagaggtcttgcaccgtactgcagatttacatacttctctaccaggtactgtttcacatcctcgccaacatgaactgtaatccccatgccatcacaccgagccgtcagatcctggatcagcagactgacaattgcgttcatatcctcatcgttcagctttctgaagacgatgatatcatctatacggttcaggaattccggacggaatacatgcttgatctcggacagaatctcgttcttaatctcttcattgcttccctggtcactctcatttccagtcttaaagccaagtttgcggtgtatatcgtggttctggacgccggcattagaggtcataattaaaaccgtattcttaaaacttacccttctgcccttcgcatccgtcatatgaccatcttccaaaacctgaagcagcatattaaatacgtccggatgggccttctcaatctcatcaaataagacgacagagtaaggatttctacgtaccttctcgctcagctggccgccgtcttcaaatcctacatatcccggaggggaaccaatcatcttggctacggaatgcggttccatatactcggacatatcaaggcggataaatgcatccggcttatcaaacataaactctgccagtaccttactcagttctgtcttgccaactcctgtcggtcctaggaacaggaaagaacctatcggcctgttcgggttctgtataccagcgcgtcctctgcgcattgctttagcaatagccttaacggcctgctgctgtccaacgatcctctctccgatcatctcttccagcttcagcaggcgggtgccttcatcggcatttacctgcataatcgggattccggtccattgtgaaactgtacgagcaatctcattggcaccaatctcagtcactgcctcttctgccggactatcttcccccgcttccagttccgtaccgtcggatctgtccagacatacagctgcggcagtttcatcgattaaatccagcgccttatccggaagataacggtcattgatatagcgtttggataattctacagcggcttctaatgcctcaggcaggaacttcaccgaatggtgcttctcatacctgtcgattacgccattcagaattgccaggctttccacctcggacggctcttccacctgaatcggctggaagcgccgttcaagcgcagcatccttttcaatatacctgcggtattcctctgtggtcgtcgcaccaatgacctgtatctctccccgtgccagacacggcttcagaatattcgcagcgtcaattccgccctctgttcccccggctcctacaatcgtatgaatctcatctatgaacaagattacatttcctgattcggtaatttcctgaataatatgctttaagcgttcctcaaagtctcccctgtatttgcttcctgcaacaacgcttgccaggtcaactgcaacaactcttttatgcttcataatccccggaactcttccctcagagatagcaagagcaaagccctctacaattgctgtcttcccaactccaggtgccccaatcagacaggggttgttctttccccagcggcagagcgactgaagaagcctgcggctctcgttctccctgccaatcaatgggcttaactttccttccctcgccatctctgtcagatcacgtccaaactgatccagaagctccgtacgcttgtggatggagtttgtcttggactcatccaattttgccaggccgattttcttccgcttcatctctgcgatcatatctacatatatggctgaagtattcacctgtgcggctttaaaaaaccgcgtaacggaaatagtctcatcctgtaatattgccagtaaaatatgctctgccccggtcagctctgcctggaaccacgcggcctgcttatggcttttatccaggatcttggtgcattccggagaataactccaggccgtctgcagaatcgtaagcccggttgacggtacccactcttcaatcatcgctgttaccagttgttcatctaatccgttccgctttaatactgtctgtgtaataccgcttttcaccttggtcagccccaacagaatgtgttctgttcctacagtgacctgccccatgttctttgctgcttctgccgcaattgcaaggacttctctggcggtattatcataatagggacgcatatctatcacctcactttacttttttcaaacagtcgcagcctccacagcatgttctgatacaaagtccattgcttttcttgttaaaatgtcctttttcaaacgccgttcctctgctccctgcatgatttccctaatcttcttctcatccaaaggatatctcatggttaacttcttgatctcggtgtctacatcctgttgtgtcacggtaatattctctttttccgcgatcgcctccaggatcattttccctttcagctggctcttagctatcccctgcatcttctttaccaaggctttctcatctgttttggaagcctcataatactgttcgatagacaggccctgctgggttaaacgaagcgcatactcctcggtcattcttttcgctctttcattcacactgctttcagatacctttgccttcgagctttcaaccaatattttcatgaggtaatcttctttttctcttcccttcagctgcgcaggaaactctattcccttatactgaccaagaactacatctttcatatgcacctactccttctcttcctcaattgacctgatgctgtcaaccgctggttcataaatacttaaattcgtcatcttgcaccgctccatcatctgtacggcttctttatatttagccaggcattcttcccacttttcaagcttttctaaaagccttgccttctcataaatgatgactgcaattgcatgattccgctcctggatccaattccttgtaaccgccgcaatcccgtcttcatccacatcaccgccgccgcacataacacatcccggatccggcatagctgactgtttcacttcctgttccttatgatctaaatatacctgtaaatcttcgtagttgtcaagttcataatagctggcaatgtcctgataaaacttcttctgatctaataacatggcactttccgctcctttctatacttattttcagtatagccacaatatttaaaattacttagtgaatattgcacacttggcgggcggggtggggggggacgcccgccagggagggagacgggggcggagggaggcgtacttgaccagtctgaccagtcaggagataggtaagtcttttgtttcaggagataggtaagtcgattcaacaggtggtaagtcgaattgttaattagtatcagtttaaaacatccattgccgttatacaagcggtttttgtatcaagcattccaagtggaaagtcgtgaagccaaatgatatatgttttatcaccgtttggctgcactcctacctgtaagcctcgaagtgatgaacttacagaatacagtgttttgttgatttttacttctccatgtttgttaatctttcttggcaggtaaccaatcggatattccagttctgctaacgcttcttcgtatagcagggtagattttttataaaaatcggagggggtacttatttgtaaggcttcatgtgggcggatgttgttgtattcttccacccacaaatcaatggcggcttgattggcctctctgccaccaggtatttttccttgaatctccctgcttatatctgcatgcatgcgttcgtgggcaccattttgcgttggacagcctggatcggtacgatccggaagaatgccaagagacatccaccatgcgcttaaggttgtcaaaccaaggaagccatttgaggaagcaaaaggagtaccattatcactgcgaatgattttgggaagtccgtagtgatagaataattcttcaaatacagctttgacagcatccgcagttgttctctccatcaggcggatggtaagaatgtatcggctgtgcagatcacggacggtcagtggaacacagcgttccccctgggacatccaccagcctttaaaatcaacggtccagacatcattgggttgaagagcttccaacttattacgcagtttggaaacagttggatcgggatgccgaaagcgtcgtttgggaatcaacccagcttttcccaaaatgcgataaatactactctcagatggtgttggcgactctggataagcgctcttgtaaagaacggccagtttcttaggcccccaggccggatgagcggaacgcattttaattaaacgaatgacggtatcttcatccagctgattcggagaattagaaggggccttgctctgatccgcgaggccggagaagccaaattccagaaagcggtttttccacttatgtccagttttttctgagattccaaacttttgacagagagccttaaagctatcagttccacatagatattctgtaataaattgtttactttgttccataacagaggtctccttccatggcatacagaaacaccttctttcgttggttatttctgtatagtttaacatttggacttacctatgtcctgaaactttttacttacctatgtcctgaaactggacaccggacggcaggtatggtgcaatccctgcgggatgcataatcgggggcagcggatggcgaatggctatgcagtgctttatccgggatttagagcggggctttgaattgtccgttgtgtggtttgttcgagccttacagttgaggggtttcttccatatatgatgtatgtatacatagtaaatattatgtcataattaaatagctaagaataggataaaaccatagataatccccaatacacatcttacttttataccctttattatagtaaatacacatccgccactcccgcccagatcccttaaaaatgtagccgtcttaccgcgttgatgcgccagacctggaaaacggacatgggggtgtacggatgcgtcttttggctgttagtcagagttaagaaaaaaggaagaaaaaatggggcaaaaacggtgatcccgaatcaccgtttttcctggccccagcgcgcaaagccatcaaggctttgggcgatgtggccacggtcgccgcattttttcttccttttttctttactctggcttaggcttacagccaaaacccgtatccgcacacccctatgtccgttttccaggtcgtccctcacccgccataaaactccctacatcctacatctacaactcaatctcaatatcaaacttttcttttagcacttcttttaagcgtccgccaaccggttctattataacgttatcttctgacacttctttatactcatcattgataagcgtgcggtacccatcctcggtacgtatgttaataactcttagcatacagaaacgcgcatctttacatgtcgactgaaaataattcaagaaggcaaaatcagaactaaagcatgctacatcggaaaacagtatttctattctctccgctgcatcttcccttcctacttgctggctgatacgggttttccgatgcacttcataccatccctttatactgggcagaactcggaatgactcttttttataggtctgccactcgtcggtgtcaatctttaatgcacctgcaggcattggacctccgaggccgccgtcgcagaaatattctgctccatcaagagttacgattatcgctctgtgatccgcccaagtcgtaaagtcatccgatcccagtaaaacccttacaaaacataatcttgcatcgtacccgagactaatgagcagacgatataataacccattcagttccaggcagtatccgcctctttttccctgaataattttctgaaatacgtagtcagggtcaaggcacacttccttatgtaaatcaaaactgtctaaattttcaaatggaagtgaacattgttggcgatagattatttcatccagcgcttctttggtaggttcttccaccggagacatgcctatacggtccagatattctttaatttcttccggagtaaacttcttaacaacttcttttacttctctcatcttctgctaccattcctttctctgacagagtatgtttgataattcatgtgcccgggtgagcagggcggtcagataggcgctatgaattatcaaggacgctctaatcttgtttcattgtttccctttataataaatggccttcacccatttattcctgccggctgccttgctgcatcaggtatactattataaaaaagtactcctgccaccatcagcttctcatcaatttacacttgcttttaatgtaaataaaatatcaataattgcctagtgaatattgcacacaaacagcggaagcagcatcgcttgtgtgactgtaaggaatacgtatcgaaatatggaatggccttttaacaaaggatgtagataccctcctgacgaaacaaaccgggaaaacagacactctccagcctgttctcccggtttgctctcctataacaccataacttttcacactgccctacagcagcagatacaccaggatcaggatcatcccaatccccgccagctgcagcccatatgaaaggctgtaacggatcatatcccggctttccttcctctccagcgcacggatccccagcttcctacggtatgacacattctcctcctgcttctttaagtacgccgcgccttgatccagcagcttcccgatggccgtgtccactttcggcagcgaccccgtacggtaaggaatcttccggtccctatacagcgtcttcctaagcgccaccaccaggccgtctaccagcgaatccccgatccggcacacaaagatcccgataaacggcagcaccccctggatcagcggacggtacaccaggttctccaggtccagccatttcggccacgcatccacataggtgctggcgcccccttccttcttgcgcaggaacaccctccggatcaccagcagatacaccagggccccgatggcgattgagatcagccccccttttaagcactccatgctgaagaagtgggggatatgtgcctccccttccatccgcataaagccctgggccgcacctgccagcgcttccatcgttttcaccggcgtcatccccagcaccggcaggactgccgcgctcacgccaatcgccgccatgctctgcttattgatgtagtgctttcccatgccgtcaaattccgcctgccttgccggatccgcattcttctcccagaacaccgacacatacagcttcagcatatacgccaccgtcagccccccgctgatcaggaacatccattccacaaacacaaacaccggggccttggaatactcgatgatactctcatggagcagggtcttgctgatatacccgttccagaacgggatgcccccgatccctaaggcccccatcagaaaggccaggtttaagaacggtttctttcgcccaaacccacggatctcattcaggttcagctggtgcgtgttcataaacactacgcccgccgccatgaataacaccagcttgatcagggagtggttcatcatgtgcaggaaggtcccgtgcactgccagcccgttttcctcccccagcaggcactgcatccccgtccccaccaggataaacccgatctgggacatggacgagcacgccagggtgcgctttaaatccacggaaaagactgccagcaccgcgcccccaaacatggtcaccacgcccagggccaggatcaggctgccccacttttcgtccccgtagaacatgtagcagctgaccaccaggatcccgtatacccccgccttagtcaggataccggacagcagggcggaagccggcgccggcgctaccggatgggccttgggcagccagatatggagcgggaaggcgcccgccttcgccccgaacccgaacagcaggcagcccccggctatataaagcagccttttatccggataactttggcaggcctcatagagcgccccgatctccagcgtgcccacggacgtgtagagcagaaacagccccatcagcagcaccatgcccccgatcaccgccactgccaggtaagtctgggcggcccttaaggattccttcctctcatcctgtgcaacccacacgtaggacgtaaaggacatgatctcaaaaaacagaaacgtggtatataaatccgcggacaggaaaactcccacggtagcccccagggtcaccagctggaacaagtaataccggttccggttccggtaatgcctgaaatactcccgcgaaaatacaatggtcatcatccacatgaacccggccaccaccgcgtagatcccccggaagccgtccatactgaaatgcaggcccatcccgcagatcccctccaggatgccctcgctcccctgcaggcgcaatgccccatagagcagcagcaggaattccgtaatgacgatgaaatccgcaaagtaattccgtccctccttggatttcctcccgatcagataggtcagcagcgccccggccatgggataaaacaccgggactgccagttggattccattcatgcgtgccacctcctaaaatacctcattctcaacctcctgtaatccaccggttactgcttcctcaaattcaccggttaccgtcttcaaaaacacaccggccttttcacaaaagccttccggttatccactctaatacacgcccgtcacaaccttcgccaggaaatccgtaagcggcgtgctgtacagcccgaacccgatgatcgccagggaaaacagcagcaggggcaggaccatctgccagctggggtccttcacccccgccagggccttctcatcaaaccctttctccgggaagaagccccttaccacgatggtcatcatatagatggccgtcaaaagcgccgacaccagcaggcaccccaccccgatccaggccaggtggttcccgctttctaaggccccctttgccaggtaccatttactgatgaacccgcaccccccgggcacccccatcatcccgatggccgacaccgtaaaggccccgtacacccagggcattttccgcccaaaaccgtccatctcatagatatagtgcttgtgggtctggtgcatgatggatccggcgcagaaaaaagcgctgatcttcatgaccgcatggaacaccatatggcacagcgcgcctaaaaggcccgccggcgtcatgatcgtggccccaaagatgatgtaggacaggttgctcaccgtagagaaggccagccgccgcttcatgtgcgtctccttcacgcccatgctgcagccgaacaccaccgtgaacatggccagggccattaccacgttctgtgcccaggtcccccgcagaagctccgtgccaaaacagtaataggtcagccggatcacggcaaatgcccccgcctttaccaccgccaccgcatgcagcagcgcggtcaccggcgtaggcgccacgcccgcatccggaagccaggaataaaaagggaacatggccgccttgatgctgaagcctaaaaacgccaccacatagagcagcagcaccaggtccatcccaaggcctgccgtatgcccctggaggatcccccccagggtgaacccgccggggcccccgcagcggaccaaaaagaccagccccatgaagcccagggccgccccgccgatggagaaataaatatatttcctggtcgcaaggaccgcttcccgggtaaaggtatggagcaccagcgggatggtcaccagggtcagcatctcgtagaagaaatacatgctcacgatgttggctgaaaaagcaatgcccagggtcaccccataggtcatggtataaaacatgaagaacggctgctcccgctcttccgtagacatatactcaaaggaatacaaggtggcaatgggccacaggaccgagaccagccccgcaaacaccatgctcatcccgtcgattttcaaagcaaaggacaccttctctgaaaactgcagcagcaccagttcccccggccggttaaacaaaagcaggaggacaagggccgaagtcagcaggaccacggcttcgatatagacttccatgtgcgcgcgtttccgaaacggaatgagcggaataaagaccgctgtcacgatcggaaaaaccacggctatgattaaaaacgtttcgttcatgtccccacctccttatacgaccgctgccgctatgtttccaagaaatgtaatcaggctgcccgggaacacgcccatgagcagcgcccctgcggccaggatgaaaaggggcagcaccatcttaagcgaaggctcccgtttcttccctgcctggcagttataatctttgccgggcaaaaacccgtcgatggtaaccggaagcaggtaccccgccgtgagcagcgcgctcacaagcagcaccaccggccccagccaggagaaggtcctgaccccgctctccaaaagcccttccgccagataccatttgctgatgaatccgctggccggagggatcccgattaaggccagggacacaaaggtatagcaccacagcgtcaccggcatctctttcccgatcccccggagctggtccaccctggtatatccggtctggtaaatgaccgcccctgcgcttaagaaaagagccgtcttaatcaatgcatggaataacacatgcagcagggacccggtcagggccacgggatttaagatggccatgcccagcataatataagaagcctggctcacagacgagtaggccagccgcttcttaaacaccggctctttaaaggccagcatggagcccaggaagatggtaatgagcgccagcaccagccaggcatactgcacccagctcccccgcagaaactccgcccccgcaatgtaatacaccgagcgcagcactgccaggatcccgccctttacaatgatcgccgagagcacggccgaagccggggccggcgccaccggatgggccgtgggcagccacgcctgcatggggaacataccggccttcacgccgaatcccaggatcatgaagaacagccccaggtgcaggatggtcccgttctgggccagcaccgccgggtccatcacgcccccgggcaggaaatccatgctgctcccaaagtggtaaaacacaaagaccccgaacagcgccatgtaagccccgcacatggagtaaaagagatacttcagccccgccatgaccgcctcgtggctctgggcatgcaaaaccaggggcatggacaccagggtcatcatttcaaaaaacagatagatggtcaccaggttccccgcaaggcttaggccctgcagcgcacacaatgtcagcaggtaaaagccccagaaccgccgcctatggtgttcatggtgcaggtattctaccgaaaagatgccccccagcagccagaccaaggcaatgaaccccaggaaaaaagcccccaggtgatccagccggaaggtgatgtccaggccctctgtcagggtcagcagcgtaagctctgccccgctcccccggccgtaggaaaccagcagcagggccacagacactgcagtaagggccagggctgccaccgccgcccaggacatctttttctcctccatttttttggcaggaagcaccagaaaaagaagccctgccgctgccggtataaagattgaacatagaatccacgcctgtgtgtacatatttcctcctaatctgccttagagtgctcccttatccaaagatctccagcccctgtctgaccacctgcatcacgggcgccgcaccaatgcccaaaaacagcgtcagggccacgccgcccccaatggcagccttgaactgccagggattgcacgctgtctgctctttcatccccgccgctttttcctccgcagtcagcggagtatacaggatcaggaccactctcataaaataaatcgcattgagcaccgtgctcaccgccagcgccgccagcaccaccaccgcataggccggccgttccagggatgcctccgcaaacatcagcttgctgacaaacccgccgaaccccgggatgcccaccatggacagcgaaccggccacgaagcccacacccgctgctttattgcggaacccggctccacgaagcccctggatatccgcgttccccgcagacaccttgatcaggccgaaggccgccacaaacaccagggattttgccgctgcatgggcgaagatatggtagagccccgccccggcccccgccgctgagcccaggccgatgcccatgaaaatataaccgatctgtgccacggaggaataggcaaccatcctccgcaggttcttctgccgcaccgcatccagggaccccagcaccatgccgatgatcccgaatacaaacagcacattgatgatcccgcttcccgcaaacacttccgcccccgtcacccggtagatgatcttcaccagcaggaagatatagcctttggatacgatactggaaagcatggccgatgaggacgccgtggcattcccataggcattgggcagccacgcatggaagggccacagggcgctcttaatggcaagccccacgctcaccagcccgatggtcacgatcagcggcacccggtactccccggtctgccacagcagcaggatgctctccttgatgttgctcaggagcaggtgcccggtcatatcgtagaaaaaactgatgccaagcagcaaaagccccgagcccatcaggctcatgatcatgtagcgcacccccgccgcaatggtcaggtcattgaatttccccaggatcagcccgcaggctgcaatggtattgatctccacaaacacataggcggtaaaaaggtcattggtgtataccagcgccaggttggacgccagcatcaggtccgccatgatatagtaaaaattcgccttatccgcttccaggtccctgcgcgcctcttccatgccgccccacaaagccagcagcatgatcacgcagaataaaagcgccatggccgcctccagcatgcccgcacgcagttcgtttccccagggcgccgggaagtggcccatcacatacacatagctctcccccgtccccatcaaaaacgccagcaggaaggcggacatcacccccaccgcccccgtcatgcacaggctgagccgccgggccgctttccctttcagcgcggacgtgatgatcgccgcaaacatggcggctaaaatcgaaaaacagggcacattctgtacaaaactcattcttccttctcccttatcttgagcgatatcttatccaggtccagcgtgtggtatctctgatacaggcagatagtcagcgccagcatcagcgccgtcaccgacaccgacaccacgatccccgtcagcacaagcccgctgggcaccgggttgatgtaggcctccacgctttgcaccccgtccacgatgatgggcgctttgagccccttgatgtacccctttaccgcaaggaaaaggtacaccgccgtatccatgatattcaggccgatgatctttttgatcaggttcttatgcaggaacaggtccgtaaacccgatcccaaacaaaatgaccgccaccacctctatgaaatttgccgttaaatggcttcccatcttacagcccccctctccggaacaatgcataaaatgcatagattgtacatgccacctctgtccccacgcagatattgatgggcaggatgatccccccgcttaaaatagccccgggctcccccagcgggaaaaggtgttccagcccgttggcccccgtgtagaaaaagtgcagggcgatcaggccgtagagcagcagggctgtcaccttcacgatcacatagatcttttcattgaagaaccgctgggtcctgggaaacccgaaagacgccgcgtaaaggatcatccccgcgccgatcaccgcgccccccgagaacccgccccccggtgacagatgcccgtttaagatgatatagatcccaaataaaaaaatcaccgggcataccaccttcgccaccttcttcagcaccgtgtcctccagaggctccaggccgtagtcatccagcttcagtttcctgcgcttctcctcattctccaccatcaaaaggatcatgacgcagcaggtcgcgataaacagcaccgtggtctccccaaaggtatcaaaggcacggtacgtcaggatcatccccgtcaccaggttcacggaacccgtctcctccagcccctgggtaatataacgcgcaggcacttcattattggctgggttggactctgcccccacggaggggaggaaggacaccgcatacaccaggatcccaatcagcagcaggcacactgccacgctcaccgtgcggtacacatgcccataccctttcagccttttattccggggatagtcccggctcttttttctgatcgcttcatagtcggagggaccatacggctcctctggctcctgcaccggggccgggggcttcatctccagggtccccacaaaggggtccttttccccgtccagccaccgcttgaaccggccggacaggctttcattgtactcctcctgcggacgttttctgctcattcttccttctccttttcgtcatccttctcagctgagatccctttgatcttcttcaaagttacaaaaaataaaagggacgtcactcccgcgcctaccgccgcctctgtaatcgccaggtccggcgactccatgatcatccacaggatcgacatgatcaggctgtaggccataaaaatcaggatggaattcaacaggttcttatggaagctgaccgctgctgcgcacagcaccagaaacaccaataagatccaggtaatgactgtcatgcttccccctcctttatctcttctgcctgttctgacgggcagcacgccttcacctcttccgctgcctcaaccggacagcagtcctccatcttttcccgggacagcacttccagcttcaccaccatatgggccgcaaccggggaggtcatccagaggaatacgatcagaaacaggatcttaacactcgggaaggtgaacccattgaaaaccaccgcacccagcagcatcagcccgcagcccagggtatccccgatggccgctgcgtgcatccggttcagcacatatttgaaccggaaaacaccgataaactgtatgatataaaagacaagccccgctgccatgcatacggcgcctgccagaaagcggatccattcaagaaccatcatccagcgctccctcctccctcttttttcgtttctcattgcgtgcacggcaggccccgatatagatctgcgacaggatcaccacccccaggaaactgatcaggccgtaaatcaggctgatgtccagcaggtaggattcctccagcagcaggcccagcagcgcgatggccgcagtcacgatcccgcccagcatgttcaccgccagcaggcggtctgccaccgacggccccagcaccaggcgcagcaggcacaggaggaacatcacgcagagcactgccagcaccacgattaaaaacttctcactcaatgcccccaatacggggatgtcatgaaacatcaccttttcctcctccctctgccgcagcctccagctccacaagcttttccacaaagcccgattcgtggatccccaccgcgtattcccggtccaggctgtgcacgatgtagttcccctcctccaggtctgcggtgatcgtccccggggtcagggtgatggaattggccagcaccgtctgccccgtctgggtccggatcccggttttaaaacggacaagcaccggctccggctcccggtcaaactccaggaccagcttcgacaccgccagggccgccttgatcacttccaccaccaggaacaccacatactttaagatcttcccggtgcaccttacaatcaccagctcccgcttcggggagtactccataaatttatataagaacaaatataaggcgccgcagatcaccgcgccaaatattgcaatttccaatgtaatcctgccgtttaatataatccacagtacaaacaaaacaatgaacatcccatcacctcatcggtttcctacgaattttccgcagccgttcaggcagacctgtctaaatggttgcggttcccctgctttttgcttctaaaatggcgcgcaggatacatactgtataatatctgcgcgcctcttttttatttcacaggcatgaactctgcttttattcccccgccttccagccggcatatctggtatagactgccatggtctttcccacgtggatatggccccccgggatctgcacgatgcggggctctttcccctctgcctcccggatctttacctcgcccttttccaggcgcttcagggccgggctgtgccctgccatgtagccctcctgccccgaggcttgctctaccacgaccatctccacttccccggaatagaataactgctgcggggttacaatctttaataaaaaactttttgctgccatccgccctaagcctccttctgcacacggtccgcttccgggcctcccttatgcggtctgcccctgggcgtacttctccgttacgtcgtcaatccctcctgcaaacaggaacatggattccggaatctcatcgtgcctgccttccaggatctctttaaagccccggatggtttctttcagcggcacgtacttcccggccatccccgtaaactgctccgccacatagaacggctgggacaggaaccgctgcagcttccttgcgcgggctaccgtcagcttatcttcctccgacagctcctccatccccaggatcgcgatgatgtcctgcaggtccttatatttctgcagcacctcctgcactccacgggcggtctggtaatgctcctcccccaggattaacgggtccatgatccgggacgtggactccagcgggtctaccgccgggtaaatccccagctccgtgatcgcacggctgagcaccgtggtcgcatccagatgcgcaaaggtcgtcgcaggcgccgggtctgtcaggtcatccgccggcacgtatacggcctgcaccgaggtgatggaaccgtccctcgtggacgtgatccgctcctgcagcgcccccatctccgttgccagggtgggctggtagcctaccgcagagggcacgcgccccaaaagcgccgatacttccgaccccgcctgggtgaaacggaaaatgttgtcaatgaacagcagcacgtcctggtgctccctgtcccggaaatgctccgccatggtcagccccgtcagcgccacgcgcatcctggctcccggcggctcattcatctgcccgaataccatggccgtcttatcgataaccccggattcctgcatctcataatacaggtcgttcccttccctggtacgctcgcctacccctgcaaacacagagatcccgccgtgttccttggcgatgttgttgatcagctcctggatcagcacggtcttccctacccccgctcccccgaacaggccgaccttccccccttttgtgtaaggggccagcaggtcaatgaccttgatcccggtctcaaagatcacagaagacgtgtcctggtccttatagtccggcgccgggcggtggatcgcatcgtaacgctccgcctctacggcgcccttctcgtcaatcgtctcgcccagcacattgaacaggcgccctaatacttctttcccgaccgggaccttgatcggctcccccgtgtcggtcgcttccatcccccggtacatcccatccgtggatgaaagggcaatacaccgggcctgatccgcaccaatgtgctgttccacctctgctacaatggtctttccgttttgctcgatatgtattgcattaagaagattcggcatctgttcctcatcaaacttaatatcaataaccggtccgataatctgttgaatgattcctttattcaattgcctcacctcttaatttctgagcctccgagccggcgatgatctcaatgatctcactggtaatcgccgcctgtctcgctctgttatagtaaatagataattctgtcagcatctcgttggcactgtcgctggcattcttcatcgcaatcctgcgcgccgaatgctcgcacaaggtcgcctccgcgattgcactgtacaggtacaaagccaggtactcctgcgccaggctgtcaaacagctcccgcccggccggttcgtattccatcagggtcaggtcacagtcccctgcctgcccccctgcctccagcgggaacaccggggccgccttcacctcatgggaaatcgagttcaggtaggaagcatacagcacccggatgcttgtaaaacggccttcccggtacagctccagcacttcccctgagagccggtacgcttcctcgtaccccatctcatccatctgctcccgctccgtctccagcatctccaggccttcccggatgcagaactcttttccctttgtcccaagggccgcgaaacagcagctgcctttttcttcctctgcgatctgccccgccgccttcgtgatggaggtattgtagctcccgcacagccctttgctgctggtgagcaggatgtacagcgtttccccgtcccttggttccaggtacacttccggcaccccctcctcggtacgcaggacctgcccgtaaagccgcttttcctcctccaggtgtttccggatatagtcgaaccggttcgttgcctgcttcagtttcgctgcggaaaccagtttcatggcattggtgatcctctccgtgctgctgacgcttttcatcctgcgcttaatcgcctgcatctggtcagccatcgaatctacccgccttcctgcattcttctatgcccttcaaaagctgttcctctgtctccgcttccagtttccctgtatccgcaatggctttccccacatgggggtaattcgtatccatgtactggtacagttccttttcaaaccgcttcacctggcttggcgcaatgcccgccagatgcccttttactgccgcataaatgatcatgacctggtgttccaccgcaaccggctggtactgcccctgcttcaggatctccatcaggagcatgccgttctccagccgctctttggtatccttgtcaatgtctgacccaaactgcgagaaccctttcagctcccggtactgcgccagcatcagcttgatcgttcccgccaccttcttcatggccttgatctgggcgctgccccctacccgtgacaccgagatcccggcgtttaccgcgggtctctggcccgagaagaacagttccgactccaggaagatctggccgtccgtgatggagatgacgttggtcgggatatacgccgacacgtcccctgcctgggtctcgatgatcggcagcgccgtaatggaacccccgcccagctcatcggagagcttcgcggagcgctccagcagacggctgtgcaggtaaaagacatcccccgggtacgcctctcgtcctggcggacgcctcagcagcagggacatggcacggtatgccaccgcgtgtttggacaggtcgtcatatacgatcaggacatctttcccttcatacatgaattcctcccccatcgcacaccctgcatagggcgctatgtactgcagcggcgccacgtcgctggccgtcgccgacacgatgatggtatagcgcatcgcatcccggtcttccagcgtcttcaccagctgcgcgatggtcgactttctctggccgatggccacatagatgcagatcacgtccttgcccttctgattaatgatggtatcaatggcgatggccgtctttcccgtctggcggtccccgatgatcagttcccgctgcccctttccgatggggatcatggcgtcaatcgccttgatgcccgtctgcagcggctggtgcactgacttcctctgcagcacccccggcgccgggctctcgatgggccgcgtcttatccgtctctaccgggcccttcccgtcaatgggctcacccagcgggttcacgacacggccaaggagctcttcccccacaggcacttccgctacccggcctgtcgggcggacaatgtccccctccttgatgccccggtctgctccgatgataaccgcccctacattcttttcctccaggttcatggccatcccgtagatcccgccggaaaactccagcagttcccccgccacacagtggcgcaggcctgtcacacgggctaccccgtcccccacttcctgcacggtgccaaaatccgtgatctccatctggcttgtataggtttctatctgctttttgatctggctgctgatctcctctgtattccacatcatagagaactccccccttccggcctgcttcgaagcctcaagcttaaatcttccattctcttcttcagggaagcatcaatgagtttcccgtctgcggagatcaataccccgccgatgaggccttcatcgatcatgtttaccagggtcaccggcttgccgatcagttccgccgtctgctcttccaggcgcttcaccatttccttctccagcggcaccaccgaatataccgtcccacggatcccctgtctttcttctcccagaagctccagcccttcggccagcacctggctgaaatggtacaggccctggcggtctaacaggatgcagaagaacgccagcgtctcatcgctgatatggctcccaaatatgtcccgcatccactcaagccttgtttccttcccgatttcacccagcgtcagcatctggaaaaagttctcttcctccataaggagtcttttcagcacagccagttcttcagtcactgtatctatttgcccgcacagtttctttacctcagtctgttctgttattctttccatgatgaatcctcagcttcttctataatcttttctactacttctgcctgtcttttcgggttcagttcttctcctatgattttccctgctgcaaggacagccatgtctccaatctctctttgtagctctttcttcgcaatcatcttgtcccgctcgatttcacggcgcgtctgctcccgcacctgccccgcttctttgcttgcggtctcaagcaccgcccctgcctgggcctgggcctcctgcattgccttctttatgatctcccgtttctcggactctgcaaacgccatctgcgcctcatactcttccagcttctgctgtgcctcttcgcgcgtcgtctgggcttcctgcagcgtgttcaccacctgctgctgccttgcctccataaactggtgtactttctcaaaaaagaatttttttaagattaacactaacacaaccacggtgatcagcgaaaaaagcaggttccagttgattgtaagcagatcctgatataattgtactttcaaatccggctgcctcccttctctcttatacctttcccgacagcataatggcgataacgaaggtcaggacaccgatggtctccataattgccatacctacaatcatacctgtctggatcttgcctgctacttccggctgccttgacatgccttccagccccttgctcagtgccagcccctgccccaggccgatgcccagtgctgctaatcccatacacatcccgattcccagtgcaaccattcccatatctatttcctcctgtaatcaattcctattatttttttctttctctgctccctgcccttttcttccgcaggtgccctgtatgcccttctatgccgcactctgcagccgggcctgttactcgctgtgtcccacagacattattttgactgctgcaccgaggtttatcacggtcagcgtggtaaatatgtacgtttggattaacggttccgctatgtcaaagatcgcattcagcggcagtaccgtaaccgcacgcagaaacgggaccgtcgtaatcatgttgcttaggtgcgtcatcagatgcagccacagttcgattacgatgaaccctcccaggatattcccgaaaagccggagccccagggagatcggtaatgtacactcctccaggatcttcagcgggaacatgaacgggtacgggtcgcacatctctttgagtttcccctttaccccgtgcactctcagtgagttggccaggatcatcaggaacgtcagccctgacagggcaaacgccacatttaagtccgccgtaatcggacggatcccaaacagccccaggcagctcgcacagaatacgaacccaaggatgctccctacatagggcgcataggacttgttctccttccccatgttgttctccgtaaacttatacacccagcccacgataaattccgccaccacctgttttcctttcggcaccgtcttcagcccgcttccgagccagatccccagcaccgccagtatcacggcaatcacgagtccaaacaatgtactctctgtgataaacagctttccctctccgaagcccaatataatccgggcgccgagttcttccacgtttatcattgtttttttactcctcctattccatatacgatgaaaatagccagcgataagcctaagattcctgctgcatacatcagcactgccgccctcccggccctcatggacacgtacgcggctgcgatataaagcaggtaacggaaaagaaatatctggacaacaaaaatattcctgacacccagcagccggcctaccgccaattttaataagaagtaattagcgaaggcggctgcggatcccagaagcagcccaatcatggccttgtatccggttccacataggataccgatcattccggccactataatataaagaatatagatagctgctaacttcccgctcttattgtctttcatttttctcgtccctttctaaagcctatatgcagttatctttcaaatataagattcctcaccctctcccattttatactttttagacgtctatattaatatgatcatattctaacattttcaatatgcagtaaatagtaaattatgctcacttcatatcgaagaaatttgtttaaaattaggacatcacgccttttcgagtgtgatattcttgttaaaatgtaacaacgctcgcaaagtatagcttcttattatatagtaaacattatataatactctgcttacttcggtcaccttgttggtaattttattttagtacattttatctgatagatcaattcaatttataataaaaatcattccataatagaatgattgttactgttcagaccgtgccatgcaccccgctgcacgacatcggagccgatgatgtgatggtctcagggtaggtgccgttactgtgcaagcccacagggtgtgaacagtaacgtatgatttataaggagtattccataccacgccctatctgatccacaggcaaaacagcccaatcctcactcactgcttaggcaggcatgtttcatacttccaagttaaatatatggcttgatagaaataggtcggagactttactttaagttccggcctattacatattctataataatctatcctgtatgaacctgccggtttatctaaaaataggcacggttcaagaccctgcgcatatataacggcccgtccacatttcattgtgcattttgtttaataaacagcaagagctctattaattattatatatttttccatgcattcggcgcaattctcatttgtacatagtattattccataatcgaattgcatgcataatggcacttttatataatacttaatatatgaagaactttctactgtctgattttattctatttgcttaagtattatttaggaatatcacatcatataatttagtatacacaggaaacttatcacgcatgaatcacggaggtacggtctatgaccctttcgcagataatgtattttttagcggttgtaaaatacaaaacctttacacaggcaagtgatgaactgtacatatctcaatcttctttatccaaacaaattaaagcactagaacttgaacttggacatactctttttaacagagaagcgaaagaaaatactttaactgctgaaggtgagcgttttttagtctatgcaaacaagttttccaaagattatgccgctatgatgtccgacttaaaccaaatgaatggtgattcctacaaaagcccattggttttaggtgtgctgcccattatcaatgagtataatctaaacgatgatattgttttatttcaaaagttaattgcttcttccaacagctatgtgaacctgctcgaaagagagcaggaagaactggtaaatatgctccagttcagacagatcgatgccgctatcatccgcatggattcactggatttgtccaaatatgaatatattacatacatggaggaaccgttggtgattatatatcccgaccagatggaagaactgaataaagaatatgtcacgctggaggaactcgccgattatccaattatatgctttgacaaatcctcctcacttcacagaaccattaaacatcttttccacgaaagaggactgtatccaaagttctcttatatttttaaacatcatgagcagattctgtccatggtaaatgcaaattttggcgttgctgttattcccggcaatttagtatccacctcaatgtttcccaatatcagggttacacactttaagaagcctgtcacatcaaagatctgtctggtgcgacccaaaaatgtacctattacagagcctttgaatctgctctttcagtatttcgagtcaacttatcatgaggcgaacaaagaataatgccgtggttcttatgatcacattatagcagaggatttctaggatttccaacattaaaatctgcaaatttgtatgaaatcctgcactttcgggagatttgtctgggagtgtcgggaaaacatacagaattaaaatatttgattggagctttttccccattttttatgattctctataacagggtgtgacctgcattactttcacacccttccgcctttctctcccggtacttagctaaagatatctattcgctttcctccccgagcagcctctgcagtagatctccgcacttctcaaggacgatctcgagctgctctggcctaagcttttccacatggattccgcacgaacatactaccgtacaattttgggccttcgccaacgcttccgaaaacagccgggcgatgatatcatctttatgtcctgccccagtaagtactgaggtagtaaccccgatgccttcacctgtaaggctcggcctggcaaccgtcatcacaacactgcctgcgtgcggtgtgtccccgccatatacagccaaagtataatctttgcccatccgtatggcttcacaaataatagaaaggccgtcaaataattcttcttttaacactcttctcccgcccccatccacggcacgaatttgtcataggtgatcccgaactgcatcagcacttttccaacaatatggtttatctgatccgcaatcgtcccaggccggttataaaatgtcagcagcggcggaacaatcacacaccccatgtctgccgccttctttagatttctgatatggatcttgcccaatggcatctctctgggaacaagaacgactttgcgcccctccttcatacagacatcagctgcgcggagaatcagattctccgcatatcccgccgcaattccggcaagcgtcttcatactgcacggcatgataatcatgccgtcagtcacaaaagagccgctggatatacaggccgccatattatgctcatcatgaatatgatctgctattttcactaactcttctatcggaatgctgctctccagttcccaggtaatccttgccgcctcactcaaaattaagtgcacttcacagtcttctatacttttcaacgcctttaacaggtagcagctcatctccacacctgtggccccgcatactcctactgttattctcatgctgccaccactgcctttttaaagtctttacggtcgcaaatcaatgaaacaagcacgccgaacaccagcgcccagaatgcgcttccgatatttaaaatgcttacgccggacacaccaatgatcagggaaaagaaggcgccggttttgtaccgcccgcttttaaagccatcccggaatgcaccgatcaggacattaatcatggcaaggcctgcaaccgtatacacaaggcttaacggaatcagattgataaatgccatggcaaaagaactaagtacgccaaacacgataaagattgcgccattgacaaccgacgccgcatatctgccctcctttggaccggattcttccgaagcacagattgccgtcatgggccctgcaatattggcattatgtccaccaaacagacctgtgcagattcctccgataccacttaaaattgtcatactgttggctggcaccttatagccctttgcctccataacgcccattgcctgtgccccttccgcaccgattaccaaagctgcaatcggaaccgcacatgacaggatcagagatggctcgaaggaaggttttacaatgtggggggcaatatatgtgatttcattcatagagccgctgaatccgccagttacaaccactgtaacaataccgacaatcaatgctgccagtacacccggaaacttcttaataaaacatggtacaataaaaaatgccagcactgccagaccgcatattaacgtatctgactgtgtatatgtaacgatattcacgccaaacttcagcatacaccctgccaccatcgccattacgatttccatcggcaatattttaataatcttcccgaccaggccagtcagacccaatattaaaacgatgataccagccagaatgaacgcccctgcagcctgcgggaacgtatatcctgcaagagccgtagccatcaatgtcgccgccgaaattgcataggcgccgcagatcggcattttataatacagcgacaaaaaacagccgatcaatccgccgaacacatagatgccaaacagccagcttgccgtgtccctggcagagaagccaacagtagttgctgcgctgataacaaccattgcaggtcctgtacacccgaaaatggacgcaatcagtccgctgccaattgtgcccgcatttaaacttttcggcaaatctttaaggcccgcccttagtccaggcccttcttctataaatttcatgattaccctcctaaataagtattgatttctttcctcttttttctgcggagtatacggcaggcttttataacctaagcctgcaatattccccgcggtctcttaaaatttttatccctttataatcttaaaatccatattttttccagttctcaagtacatgcttctgcagttcctctggatatcctctgaaggatgcttctacaggctgctgctctttcggccacttgtggaaaggtgtcaggcagttataaataacccgggtagaaacggatttgctcttctcatccgcacttaaatatgcaacaagcgggaagatgtactgatccggtatcacaatccttctgtccggatgatgtctggtagctattgcccatacaagctgtttcagatcacttggatcaatgtcgtcatccacaaccacgacctttggcatataggacccaccttttgatgcaaatacagcctttccgatctccagagccagctgctcatcgtcttctgtctgtcggtttctgtctacggaaacaacgaaccagtgggttgcggtctccataggaatgaagcattcctttatcgggaatccctgtttctgcagtacattctgaatgcttgccgcaatactgattccccagttggtgtgattttcttcagtaggaacgcctgccacacacagcggcataatcggattatcccggtatgtcatagcggacgccttaaagcacggaactgtcttgctgcggcctgaccatacatatccgccatactcacccatcgggccttccggaaccatctcatccagagatgcaaagccttcaattataatctcagaagaagcaggtacaagtaaatcatttgtctcacacttgaccacatcaacagcttcaccataccagccgccgatcatttcaccctcattcactccggaaggaagcggatatcctgcgatcatagcaatggcaggatctacgcccagacaaagtgcatatggcatttccttgccaatctttttccactcggcataaatcttaccaaaatcctgtgtcggaattaccacaccggcaatggtctgcggtccgtcaagcattgcacgtgatatagcccagttaacccatgagccatctggtgtctgagcaatgaaaattccataagtattgatgtaacgccctccgtctccataatgaatgtgaggcaccggaagctttgtcaggtcaatctcttcgccaaacagcttgttttgcttacatgcgcctgtttcaacaagacgcggggcaatgggctctacatccggaaggcgtgaccatttttcaacaagtgcagggccagaagtatcagcaggcaatccaagagaaagtgccacacgtttaaatggatgttccttatcagggctcaaccccaccggcgctcccagtacctcaaatcctggtgtgcattccttaatattcttaaaaagaggagccggtgacggcaggtcataggcatgtctggtaatagcgctcatttccatattccagtccacttcctgctctactgtaacaatttccccacactccctcagcttttccacatattcccggaaacttttaattggctgcataaaatttgtcctcctttaaaattgaatttgtttgttgattaaatagtatcatccacacagacaaatgaacactttacatattttatcgtttcataaccaaaatcaatagttcataaattttatggaagcataactaaaatttataccttttttactgcagcgtatctgcagttctgcccgcaaagcgccagtctatgaggaattgctgggaatctcctattctgaccgctgctgccgggccgtcccctgaacactgatctgggaacgttccccatctgcaccgcaatgatcactctggaaaaaacagttctggtatgctatcctaaattcgtaagaaatagcagcagtatacgattctaagttcttaagaaacacacaccatgtacgatatttaattcgcagggaacaaaatcaccagatacaaaggacgagggggaaatagaatgaacagcaaccaattgtaccattttaagacgattgcggaatgcggcaacatcaccaaagcggctgaagtgctctacatcacacagccagccttaagcacatccttaaggaagctggaggaagaggttgcaagaccgctgttcatacgagagggccggaatctcagattaacagagaatggcaaggttctgctaaactatgcccagatcgtcacagacgccattgagcgtgcggaggaatactttagtgtacacgaggattcccaatcggtgaacctgtaccgcataggcggtgtggcgggaaacctgctgaccgaagaatgttttaccatggaaggtttccgtctgaactgtctgcttgtctccaaccaggatctcgtcagaattgcttcgtccggtgttgcagatattataatcgcagatgacaggtacttaaaaaatgccgcacataagtattcagaaaaagaactgctttatcaccagcacctaattctttccgtattgaaagatgatccgctggtaagattaaacgaggtaaatgtaaaggatctgaacggactgtcgatgctaggacatgtgaatccgctgggatttgcagcctggatagatgagataaagcgcgataaccgctgtgactttgtgaatgaaattgcactggacaatatgacatattttgcagaaagggataaacttccctggcctgtttttataagttcttttggaatcggaaccgaaagaggcaaggattatttttcaaaaagaaagagtattaaagtaaccggcagatatacagagcgggatattttcatctggtataacaaaaaaagcctgaaacggctgaagccgctcatagaaaaaattaagtctaatgctcaaaaaacgctggaactggataacgcctcaggttatttatagattcaaccggtaaatggaatgcggggataagagatgagtataagaatcatgactgcaaaagaggctgtaaagctggtggagtctaatcggacattatgtacggaagggtttgtaggcgctgcccttgcggaagagctgcttctggaactgcagaatcgttacagagaaacgggaagcccacgggatctgactctgatttatgccgcaggtcagggagacggcgatgagcgggggctcaatcatctaggggaagaagggctgctctccagaaccatcggcggtcactggaacctgtcgggcagattgcagaaactggctctggaaaataagatggaggcctataacctgccccagggcgtcatatcccaaatgtacagggatattgcagcgggcaggcccaccatttcccatgtaggtcttgatacctttgtggatccaaggctggacggaggaaaactgaatacagtcaccacaaaagaaatggtgagcctgatagaaattaacggaaacgaatacttaaactatgaccagcttcccctggactacgcctttatccggggaacctttgcagatgagcgcggaaatatttctatggaaaaagaatgtactaatctgggtgttcttgcaattgcagaagcggtgaaaaactgcagcggaatggttatcgtccaagtggaaaatgtagtcaaagcagggacactggatccccgttatgtgagaattcccggcgcattggtcgatgtagtggttccggtatctgacaggaaataccatatgcagacctttgggacacagtttgatccggctttatcagaaacttctgcgctgtccaggagatccaagccgcttaaaatggacatccgcaaactgatcggacggcggtgcgtcctggagctgacggatggaaccattgtgaacctgggcatcggcctgtcggagattgtagccgcggtcgcttatgaagaaaggattggagagactgtgactttcacaattgagggcggggtgaccggcggcatggtcttatccggcatggacttcggcgctgcggcggccccggaatgtataatggatcaggcctctatgtttgatttctatgacggcggcgggctggatgaagcgtttttggggctggcccaatgtgacagactgggaaatattaatgtcagtagatttggttccagaattgcgggctgcggcggctttatcgatatcagccagaacgcgaaaaaagtggtgttctgcggtacctttacagcaaaaaatctggaggtaaaggcagtagacggaaagcttgttatagtcagggaaggcgagattaacaaatttgtaaatgaactagtgcaggtcactttcagcagtgggcgggcgcgcagatcagggcaggagattctctatatcacggagcgtgccgtgtttgagatgacagcagacggaattatacttactgaaatcgctcccggaatagacttacaaaaggatgtgcttgaccacatggaattccaatgtgccgtcagcaaggacttaaaatggatggatgcgcgtattttccgggaaggaaaaatggggcttgcgccccattaatctcatttaggaagttcgataatcttatccagttccagtccatggaacactccttgaaatgtaagatgtgtcaacagctctgcaagataagaggggctgtacttcataccgtcttccagccatttgcctgtgattccgatatgggctgaaataatgtactggataaggtattctttaggaatggacagactatcgtcgctgaacctgctcaggatctcagtataggtaatccgggcgctttcctccatcttctggcggaaggaagaaagaccgttacttccaagcattaccctaaaaaagtctgcgttttttgcaatatattcaaagtgctttacatagtatttacagcttttttgggaatttaagccggactccctggcataggaatccggctttgtttctttccgtagctgataaaacatctcctccactatcgtgtctaaaaaatcctgtttatcttcaaattgcgaataaaatgtacttctggcaacctgtgcctcttctaccaggtcatggacggtaatctcatctattgttttctggttcatcagatgaattagagcctcaaccagatactggcggctgcgtctttttctgcggtctccacactctttcattgatacccctccttggcagatggatttatatatattataaatccagtcaagccgtttgtaaatggggcgcgtttgtcactgtttacagtctcacccgtaaacagtgacgcgcgcttaggaaattgagggtgcgttctttaccgcacggtgggattttgcaccggatgaggcagtgccaaatctgccggcggcaaatctggtcaagaagggtgtaataaccgtagtaagtatcataaccagcgcaatctgcgcggttgccgtctgcagataaggcgcatgttcgggaactgcctgagcgatctgcgcaggagcaccgattgcaagccctgctacgcagcaggttgctatagaaccataccccggacggcgtaaaatccaccggtctgtgaaaaatgacggaattacgcttatgatgtaaaatataagagtcagaaccagcccctgcaggcccgaccggaatgcggttacaaggtctacagatattccaaagcagaagcctaaaaatggaagcataatcatggatccgggcgccataagttttcggatatctgcatctaaattcccaagcagaattcccaggagaaacggtacaagaagtgctatgagcgccatataatcaaaggctgcaccgctggctgctcccagaatcagcaggggaatggtgggcatacaggccacattccagagtccgaaggccgcatgatcaatttcatctccataaattttcgtgagtgcaagaaatactccgggattattactggaaagcacggatacaaaggccatggttgatatgccaaaaaatcctttagccccaaagttgtgcatcagcagcatgcccacggcaaacgcagccgccagctttataaccagcagagtgccatggcgctttaaaaccgctccgacctgccggacgggaagctggctccctatgataaagagcagcagcccggcaagacacatggtcccggctgatgagaaaagcgccgtggttggccccccgatttcaacgattcccggggcccatgtatgtatgaccgctgcgatcagcaggggaccgaccatgagtcccccaggaaacttttccaccgtttttaagatcttcaagatatccctcctatcttgaattttacacatccaccctgtgcctcagttagccggctttttctgccggataactgattacaggcggacggcacaacgatcagatatctaatttaagaagttcagcggcatttgtccttccaatccgaatcctgtctgcatagctgagcggtacgttgtcaaaccaggtggcagcctcatcaagactctcatacggagtatctgaggagaacataacatgcgtgttgtcgcattccatcagggtatcaataaatgctcgtgtgtggaaatggccgcttgttgtcatatatacgttcttttccatgtattcggttaacggctttttatgggcgccgcaggctttctgattattcaggcggtgctggagacgcggaagcccgaatggaagtccctcacccagatgtcccagaatcagttttgccgtcggaagctcatcaaagataccgctgcataacaggcggatcgcgtggagggccgtctcggcgccgaatccccatgctgagcctaacagtccctcatagccctggtatgcccgctgctggttcggtaccggatcacggggatgcagatagagcggaacatccagttccacaagtttcttccagaaaacaaaattctgtttttcatccagatattctacgttattcttgtcattcttcatagtatagccgttaatcagtgcccccacgaatcccagttctttaacacagaattccagctctttgcaggcagcttcgggatcctgcattgctactgctgcaaaagcgttaaaacgtttgggatatttctgtatgtaattttcataaatccagatattcatctcatgtgcgcgttttaccgcttcttttgtatccaggacttcctggatacctggctgtgtcagggacatgataaacatttcaactccgttacggtccatatccgcaatacggatatctgcagagtgtaatcgtgccttaacggcttcgaaataatcctctttatttctggcggtctcattttgcggatcgcctgtagcttcccactgaggggactcgtagtgttcttccagagcaatcttgccatgcatgatttcctgcccgtaaggagcaacatagtcttttatatattcttttctgaattcaaaactcatattaaatacctcctgaaagttttttgggaaatcttttgcgcgccagatttctgttgtttatgggtatattatagcaatggattttttgaattgccagcctcagaaaccccgtttttgtagggattcctccattttcagaaggaatgttcgggaagattgtgataacaaacatttttgatgaaattgtccgatgcctgggtgctctgccgtatgtaattaaagcaaaaaaggccttacaccacgtagttcataaaaaacgctgtaaggccctggaaatattcctgtccaaaatttactttttctcttaatcgtccctgtattcttccacaattaacctcttctaagccttcttcggaaggaaaattctctgtttaaaatcttcctcatatattctcacagcctcttcttccgtcagttgaggcagctgttcgcaaaactcatttccgctgttctgctcaatatacctcagcatttcaaatattgtattctgcatatcagtacctcctctcacattcaggtccggctttgctctgcttctattataattttaccgcacataacgcgtaaaatatatttccttaacgactgttttatggtaaaatatcgccataatgaaagatgcactcttaaacccgtcactgtaaagcggctgccgggattaaaccataaggagaaaccggatgtttcctgaagacttaatgttcgcttcgaataaacaagaaaagatatttgaaatgaggccagaatacccttttattatcagacatgtctatccgcagcgcggaaaatccatgatcgctccgtggcactggcacgaggaactggagttgatttatgtccaaaagggagccgtgacttatcatactccgcaggtgagtctgcggatcgaagaaaaaaacggccttttcacaaacagcaacgtattgcaccaggttctttcctctgaacccgattcagaaatcttttataaagtatttatgtttcgcaaaaattttcttgcagaagaaggaagttatctcgataaaaagtatgttagccctctgctccaggcgaatgccgcatcttcccttttgttgtcccagtctgatcctgcccggaaaaagattctggaacagctgctcgagctatccgagttgaatcagatcaggccctttggatatgatatgaaatccagaaatctcatgtccgacatctggctgcacatagcggagattagtaatataccgcccgatccggttcctgcatcctcctcactccgggaaaaccggctgaaaaaaatgctcctgtatatacaggagcattacatgcacgatcttacattaaaagacatcgctaatgcggcgaacattagtgagcgtgaggcactgcgctgttttcaagaaggcctccatacatccccgtttgtttacttgggagaatacagagttcaaacagcatgcggcctgctgcgcaatacctcagacaatataacagatattgcgctcagatgtggctttgcttccagcagttattttgggaaagtcttccggagacatatgggctgtacgccttatgaataccggaatcgttaaccgcagtgagtttttaaaatactgcatgccaggcagacctgctgcttattgctctcttcaatttcattttacggcgtgcttctttttataatcgcacccaaatgcatccgcaatcttcattatttgaacaatatcctctttttggcatgtcctgctgcatgcctgccatgagtctgcttccagagactcttctgcaatctgctgtaaattttcttccgtaagttcaattgacatatcctcaaagcagactggtattccaatcataatgcaaaagttaagaacttcttccagcgttttagtgtcataatgctcggcagccaactggcatattacaccgaatcctacacgttctccatgcatcaggttttctccctccggaagcacggtgatggcatttcctatcgcgtgggcaatcgaacatcctacattctcaaatcccagcccgctcattagaatattacattcgatgatattttccaaggcgggaacgcacaaatgtctttcacatgccagtttagccgcatatccatcctgaatcagtgtttcatagcagcattttgcaatggcccggccgcttactgttgaaacaaacggctttttatcacaccatacataattttcatgtccgctctgtatatttgacaaaccttcaaaataggttgacagcgcatcgcccattcccgcagtcaggaaccttgccggagcctgtgcaattatcctgctgtctgcaagcaccagatctggattccttttatgaagcattatctcattcattttaccgtcttcactgtaaagaatcgacatcgcactggttggcgcatctgtggatgcaattgtcgggcagatcagaagcgcacagtccatccgggccgcggtcacctttgcagcatcgatggatttaccgcctccgattgcaatcactgtatcaatttcagttcccactgcctgtttctggaactctgcaattttgcggtgtgtaatctctccttcatacgccccgcagctgaacgtacttttactgttccggtacaaagctttcagtttttctttccactcatcataaaaaaatacatcaataatataaaagtgtgcttgtccaaattcactcgcataactttcaatctcttctaaaaggccgggcccctgtatgtaatgtcctacggacccccatgcccggtaatttgtatttcttctcattcttttttcatcctgccatttctaccggctgcgtcctatttctccatatttgctacccggattccttttccaaataacccttcccaatcttctttaaatgtatcaagcgtcttttgtgtcataggatgaaccgccattgtgtccagcatttccagagtaaccgtaacattatctgcacctgccaaagctgctttttccaaataaactgcactttttagagaggcggccgacaccttgcagtccatgccttccagcacgaaggcatctttaatctttttcacgaccccgattccatcgcctccggcattatcaatacggctgacatatactgcgacacagtaagcgcccgcttctgctgccagcattgcctggttaaaatcataaatagcagtacaggaacataagatcccctcttcttttaacaatcggatcgccttatacccctgtgggcatgccggtatctttatgaacgtatttcccttgatttcttcccggattctatgcgcatcctctatcatttcctcagccgtatcccccatagcttccagataaaagggatattcctctccgatgacttcgcgtatcattctggcattttccagaaatgttctccccgtccctttcaggcagcggacagcaatactcgggttcatactgaagcaccggaccgggtataaatccaccacctttttcaccatttccaaatcacccgtatctaaacaatattccatgtcttgtctcccttcactattatgttatcctaagatttttagagcgcctaatataactgccaatatcataatcccaatcacctggactaaaacattcacatgttttctattcagcttgtataagccaagtgtgacggcaagcgggagcaaactcgggaaaatactgtccaaggtctcctgcagcgaaaaatttgtatcgctgatattaaatgcaatgggtgttgtcaccgccactgtggaagctaccatagccccaatcaccatcaaccctacaatggacattgacagggtcagcttattcattaaatcggattctgacaatttgctgataatcttatttccaagcccatacccaaactttatcccaaaataacgcaatgcaattgtcggaatattatagataagcaggaacaaaatcggtcccagaatactcccgctcatacatagccccgccgcaattcccgttgcaataatacgcagagtcccggcgatcagggagtctccgatacctgccagcggtcccatcagagaaactttcatcgcactgatggaagaggtatcaaaattttcattattcgcattctcttcttccatcgccgcagtgatcccaaagataaaaggctgcattgtggtctggcaattataaaattccatatgcctctcatatgccgcaatcctgtcttcttccttgtcatacaatttattgattaccggaatcatggcatattcaaaggccatgtgctgctgcctctcataatgccatgcatgagaagtggtaaatgttcgaaagaacccctttttcagttcttttttcgtcaatgttttcctagaattcgttgtcatcatctatacctccttgtactgctgatttctgagccggcataaaatcttttgcaatcaataaaatacctactattacaactgaaaagcatacaatacctaccgtagacacaccaagatatgcgcttaacaaaaatccgaacaggaagaataccgcaacctttctggacatgatcatgctgatcagctgtgcaaaaccaagtgcagggagaattcctgctgcaattgtaattccagatgtcagccagcccggaattgcagatactactgcctgtacagcatcccctccaaacaaaaatgcaacaaacgcaatcactgcaaatgtaaggtcaaagaggaaaccatttgacaggaaaattgcttctattttcttatactttccctcttctgcaaaccggtctgccgcccttgccataatcggtgtaatgactccgtaaaacagattgacaacaaatgcggataaaattgctgccggcatggcaatcgtaatcgcagtctccattccattccctgttgtaattgcaaaagcagtccccagaacagaaccaacgatcatatccggaggaatggaagccccaatggcatacattcccataaacaccagttccagctggaagccgatcatgactccggttttgacatctcccaagattattccaaccagcgcccccagtaccagaggcctgccaagcattgcggttcccacaaaataatccgcttttccaataaatactacaagaccaaccaaaagtgcctgtaacatttgtctttccctcctttattagctcaacatttcttttgtaaccattttctttttatcttccggcacctgccggatttcaagctcaaccgaatcatccagcatttctctcagcagcgtgcattcttcgtttgttacataaaaggcaacatctaattttttcgaatcttctttgattttactaccgcctaaattgactgatttcacgacctcacattgttttgccaggctgtgtgcatcccgcacgctttctacaacaaccagcagtttatatttatctgttactccactgttaattgctttaatagaatcttccacacttttaattacaagctttattcctgacggcttcgcaagccgcattgttgccatccgcatttcatccttagcggctgcgtctgacacaattaatatggcatctgcgtccagcgaacggcaccagacataggctacctgtccatgcagcagacgatggtccaccctgcataatttaatcatttgcataacctcccattccttctgtacactcttcaaactttttcagtgtctgatcatcccatttttccggctctctaaaactcctggaatccacatattccatagaaaagcctcccttatatttatttttatcaaagctctccagaaccgccctcatatctctttgccccagtccccatggcatatgtccggtcgggttaccatctgtaaaatgacaatgaatgatatcctttccaaacagatcaaaccactcctgcacagattctcccacatctcctaatgcgccaagatcaattgtcagcttcaaattgtttcgatgtaccgcttccttcagtatctgaatcttctcctttgtattggcaatttccgaagacttattccagatactttccagcaccagttctatcccctgatccccagcgtaatcacatagccgccgcagcatttttgcagacctgtcccttgctgtttctgccttttcgtcatgataattccacccaggcgtcaccagcacttttttgcagccgatttcaccggccagactgatgacccttttaaaatacatttccgtattgcgaatcaaaagctctgatcttgctgcgatattgtttggttttggattattctgttccgggcagagacaggcaatttttacgccgtacttttccatcagttttttcagtttatcagaactctcactccaaaaactgtttatgtaaaaatgttgggggcacagccataattctgcattcacaaactgcattttttggcatttttcaaaaaagtactccaaatcataataccggtaatgaatattcatggcgtatagttgttccctgtatatcacccttttaaaattcctccttttctttagacatatcctccaccattggattacagaaacaagtcatttcctttcctccttccacggcctcttctattttactttggatatcatccgtttctttgatcatcgtcagctgtacaatcattggcaggttcataccggatacaagccaaaaattttgtttccgcatacgggcaagaaattcattattaacgctccccccaaaaatatctgtcgctacgatgatttcatccgtatcagcaaatctgccgaataattcatctatctgactctctaaagttactttgtcttctaaatatgcacagattgtatatatctctgccgttttaccggcaataaactgtgcactgtttttcattccctcagcaagtctgccatgggaagccagcaccaatctaagcatgtgagctcctttcttttatattcaacatctctgcggacaggaacttcatgaatccggccttttcctgccttatagagttgttatcaaaaattattttcgttttcttccacttccacatcatttttgatatattcaaacaaataggcaatttcactgtccggcaatttcacattatactgttccagaagtgtccgaaaactttcatttacaatccggatgaactcttgttgttctcctttgaatctttcaatttctttgtatttttctatcggtgtctttgtcacaagccgttcaatcaaaaaacagatatgcatattgatccctacaactgtcttgcttagaaactttcgtttcagcatgtgttgcagcagcatggtagcatcgctgacataatccagtaatttctgggcatttaagattgtcagattttccattacggattgcagcgaaaagtttttcagaagcgcctggtcaaacttttcaatttcctcctgattcaaataatatgaaagtacatgatccacgatatggatttttttaaagttaatgatctcctccaaagaaacggaattgacctcttcgatttttaagcttagagtttttacaagcagtactacttcgtatttttcgaaaagcaaatcactacttccattttgttccaatttgtcaaaatcatatgctatcatttccaaaggaatagacttcggcaggcttccgcgaaacattcgagttaacttttccgcaatattttttcctacttcgcttgtaaaaacaatcgccttctcctttttttctctggaaatgatattaaagtggcattgattttcccggcaggctctctccaaaatatcctgcatattatcccctgccaggatcatatttccgatattcagagccagaatcgtagacacattattaatgactcctaaattaaccgttctgtctatcatctcgcccagcccttccagggaaccggtatctaccataaggataatatttttaaaatatttattttcattaataaatactgataatttctgaatgacttcatcaatggagctctccatcggcatatcaattgcctcaaaaagctgcgcctggagagttgtgtttaccacatcggcgatggaacttgctgtggtatacccgtgacagagcacaatccctgtcgtatccatgagttttaatttattattgtacgagtggatattaatcataataaatacccggttcatcggagaaagtacaagattaatatttgataaaatctgcttttcaagcaaatcagccaaataatgaagatccggcatattttctaccagaaattgatacatcttctgaattctttcctggttctccctctcccagatcttgagctttgaattatgattctgctgggcaatcagcattctggcaatcacatacgaacaattggccggaaaattgatatgatatgttcctctgatatttgcaatcatacctgccacaatattttccagcggatgcagccgggtatccagaaaggactcctgaaaaatcagaatatcgtaataatgtttcagtgtccttttgcttcgctctaaaaattctgaaaaagaaccctccacttctattgtctctttataattgtccgcaagattctgccacatttccaaaatcttgtcccccgaagagtcagcctgaatcatatccagccggaccatagcggaatctttctcatccgggcttaatatttccagcataccggcaggaagatgatactgatagatgctcagttcctgaggtgaattgcactgtgcatatgcatttgccgagatcattttgatacattttttaagttccgtaatattattttcaaaccggtagttgacaagcttgtaaattagcttttcagaaatataaatcatacggttcaggcggtcctgctcttccctgaatgcacggactataaattctttcctctcgtcctcattcctttctatccatgagggcacttcacaaaccacggggatattcaccagaaggccgggcgacatccgtctgcccgatttgatatccatacttaaaatcatccggacaccaaccatctttgcactctttttttctccgtctctgttcttcccccctgtcgtaatataatccgccagcctttcctgaacccgctcgtccagctctgggatgttttccaaatacagaatccctccgtccagcttctccagcagtcctgctttaagtccgccttcaggatcttcgctcccaaaaagtaattcttcataatgaagtgcatcttcccctgaactgaatttgattctttgaaagttttgaggattttttaaaatcttatgttttacgcagtactcctggattaacttcatcagaaatgtttttccgctccccatttcccctttcagaagaatcggaagcccgcccggatacagcagcgcagactttatttgtgcaatacagtaacttaggctcccctcgctgccaattgccttgtcaaaatcactttcctttgatacaaatttttcaatttcttttgtcagttctaaaatacttagatattcatttttttcaatctgcatgtgatacttgtgttccaataccagacggttgagataatacactggtctggaattcactttgataaccgttccttcctttaccatttcattcaaatataaggaaaccagagaccgcgacatatgcagttgattacagatatctaccgttgtataggatgatacatatttcatatcaaatttctttgtctgtttctcaagatattcataaacttgttcttttgagcttacatgtaccatatttgtcacctcctttactttccttatggcacaatcatacttcaaaacatttaccatttcttttcttttaaaaaattataacactaaatacgaaacattttctgttttcgacacttctcgggataaaaaaaattagtgtgaaaagattcttaacactagagtgtaactgtaaagggtgttgctatgcacacccctgggctgtgaatcgtaatagcagtaataccgtctggacattttaaatggagtaaggtatgatttaacaaagaaaagccgcacggctgatatacgggcggcagcgcataataaggcgggaaagaaggctcaatatatggaagagtttacacattttgacacccaaggcaatgccattatggtaaatgtcagccaaaagcaggatactgaacgtgaagcagctgcaagcgggatgatatggatgtccagggaatgctacgaacttgtaaaaaccggagatattaaaaagggagatgtcctaggggtagcccggattgctggcattatgggcgctaaaagaacctccgaactgattcctctgtgccatatgttaaatctgacaagtgcagagcttcagtttgcatatcacgaccagtgctgtgcaatagaagccatatgcactgtgaagacggtcggtaagaccggcgtggagatggaggcgctgaccggagtaaacgtcgcactgctcaccatttatgacatgtgtaaggcagttgataagggcatggaactaggcgagatacgtttactgaggaaatcaggaggaaaaagcgggctttgggaagcggacagaggagaacactgacatggctgttgaaatgacgtttaaaaagaaactgggaagtttcacactggacatgcacctgaaaagcaccagccgccgcatcggtatcctgggagcctctgggtgcggaaaaagcatgaccctgaaaagtattgcgggaattgtcacgccagatgaaggcaggatcatgatagatcaaaaagaagtatttaattctggaaagaaagtaaactggaaaccgcagaagaggaatgtaggatatctgtttcagaattatgccctgtttccgaatatgaccgtagaggctaatattgctgccggtttaagaggatccaaggacgaacgggctaaaagagttgaggagatgctcggaaagttccagttgagcggtctgggagagcggctgccgggcgaattgtccggcggccagcagcagagagccgctctggcaagaatcatggcatatgagccggatatgatcctgctggatgagccattttccgcgctggatgtatttttaaaagacaggctgcagcaggaaatgatcgaaatactagccgattatgagggtacagttattttggtgtcccacagtagggatgagatctaccggttcagcgaagaacttttgattatggacgacgggcaggtcatctgctgcgggaagacaaaagaaatatttacaaatccgcagtggaaagaagcagccaggcttacgggatgtaaaaacatcacgcaggtcacccatctgggaacaaatgcccttatggcgcctgactggggagtggcgctgaagttacatcggggtattcccgcggatatccggtatattggagtacgtgctcatgattttgttccgcggtggggcgctgctgccaaaaactgtattcccgtaaaggtaaacagcatggcggaactgcagtttgaacgaaaatattttctgaaaggagccgaagatggtgccgaggaaatatgctggtttgtacagaggaatgattggaatatgctggacgaaaagggaattcctgattatctgcaggttccggaagacaagatattgctgctaaaataagaatggctgccgtttgttttataaaggctaacggcagccgtaattctgttttaaaattatatcgagaactttatgtataaaatcgaggaaatatcataaaatatattgacagctcccatggaatatggtattttataaaagttgttgggaacaataacatttcatgggggattagctcagttgggagagcgcctgccttgcaagcaggaggtcacgagttcgaatctcgtattctccactatcgctcagtgcaaaggcactgggagacaattagataataatcctcgatagctcagtggtagagcattcggctgttaaccgaagggtcgttggttcaagcccaactcggggagttaaaaaaaacctgtaaatgcaagcatttacaggtttttttattcaaaggaacctttccataaagcaaaacagatcatatgtttgtaagagcgaacgtatgggtgtaaacaaaaaaattcggaatcatatcgcttatagggcaatattaggttccaagttaggaaaccacaatggagctctttgttatcggaactacttacactctgcagagtaaagaagtttttccgtttgcttgatctgtgtaagcacatattggagcaaagccgacattccatctgaaaacaggtcagtatttttttcatccaaagcacgattcatcacctcaatagtgcccgatatttcgccgcttccctctttcctccattgatccagtagaaaggggtatgaaaggagcagaaatcccgaaagtttgccgaatgtctcaaaaaaagaagataatggataaagaaccatcaagtagtccattagcagtatagctacatccagaacacagcagtttttcttatccgacaagatcttcttcatttcttgaatatgctcgttagtaagttttgagaattccctgtcaaccacatttttgaatacaaccaaaagaatttcggcgctttctcgtgccattacaatgttcttttgtatggtgggccgctgcagcttttcataattgggaggactaaatacaattcgatttccaacgccgttcatggagtaaatcagccccatatcccgcaacaaactcaccgtgcgccttactgtacttacggaaacagaaagctccaacgccaaattttcataggatggaagcatttttccctcccaatactgcccgctgataatgccataaatcatctttgcagccaacgtgtggcagtgctgaggcctgtcacggtatgtctgccaatgaaaggaaatctgcttcggcttaggagttgttttagccgcctccgtaataaatgccagcagcgtggtctgcgtaagagcctgaaatccggcgaacgcttgaaataagccggctcggtctagagcctcacagctcgatacggtcatattgtagtattcctgatattccaagctgctctcttcactgaaggatgccatacaaggaaactggaagaaagaaaccacatctgaaaacaaagtattaatcagctggttatcgacagcgcgcagcatgatttcgcagcaaaacatagaaatggatacgatgttagagcctttttccctgcaaacgcgcaatatttgcatcagatcattgtcagtgagcttttgacaaccagcataaaaaaatggtgttaaaaggagcactgctatatggtaaactacattaatctcatctttgcgggcgaggtaataattttgagtgtactggagcgcttcacttggcgtggtcttatagataacttctgtatgccttcccggtgagacaaaaatcaggttgtcctgctgcagcttttttaatgcgttccgtactgtttgcggtgctacctgaaatgtgttgccgatttgttcaatggttggcagtaagtctccttgatggagttgcccaaatagaatgtgacatttgtaatagtcataaatcaaattatatttttctcgctccacaatcagagtacctccatgcagtcataaaatcatgccgtttttttataattatatttctattatactctatttggcgctgacagtctattactttaaaaacacacagttgcatccggctcaatcccatattttaatcagctttcttcctatttttgctatcgtagggccgaagggatagggaaaaaggcaatataatgttgatttatggcaaaaaaattggtataatcagatcatatatacacacatgaacaaggagcggaatcttgactttcggatatcgtcccgcctgaagaaagagggatagtatggacagaaacatacttttaattgtagatgatgtagagcttaaccggatgctccttcggaatgtctttgaggaagaatataatattctggaagctgagaatggtgaacaggcgcttttcctgataaagcaatatcaggattctattgcagcgattttgttggatatcgtcatgccggtaaaagacggctatgaagtattggagaacatgaagcaagcacagctgacggacaaacttcctgtgatcgtggtcaccagccgggattcttcggatgatgaagtgctggcctttgatctgggtgccgtcgatattgtatccaagccctttgagccccatgtggtcagccgccgggtacataacgccgtggaactgagccagaaccgggagcatctggaacaaactgtggaggaacaggcggccagtctgcaaagatccaccaatttattggtggatgcactttcctccgtgattgagcatagaagcgtggaatcggggcagcatgtcctccgcattcggacatttaccaaggtgctgctggagaacgtcatgcagagctatccagagtatggcctgaatgaacaggaaattgccatgatctccagtgctgcggcgctccatgacgtggggaagatcgccatcccggatatcatcttaaataaaccggggaaactcaccgaaggagaatttgaaattatgaagatccatgcggaaaagggcggagagatcctgtcagttctcaatcccatccacgataaaaaatatttgcagtatgcttataatatctgtatgtaccaccacgaacggtgggatggcaagggatatccggaaggactcaaaggggaaaacatccccatctgcgcccaggcggtcggtgtggcggacgtctatgatgcgctgactacacagcgggtgtataagggtgcatatacgccggagacagcgttcagtatgattttaaatggtgagtgcgggcagttttcccccaaattgctggagtcatttaaaaatgtttttccaactttcatgaaactgacttatcagtatgcggatggtatttctcttaaagctacatttgcgaaagaggatctggccgaaaagaaaactgttgtaaatcccaccacgttggaacttggacagttgaaatatttcgctatgctgcggtatgaaggcgccactgtgattgaagcggatgtggacacaggtgtttaccatatcacctataagcagaatagtgactttgatatgcttagcacggacgggtcgttttttgatgtctataatgagttcatcctgcactgcacccatccggacgatcaggtcgggtttgatgctaaaacctatttttatgactttattgccagcggcagcctggcaaagacgcgccgttaccgcattctccgcggtgcgtcgggaaattttgtgtggtataaagcaacggctctgcgcctcacggcggacaacccggcaatccacaaaatcctgatcatctggaaaatagcgccaacggagctgtgcgatacaccggagcggaatatcgcccggctgcctaacgaggccaatgcgctgatagccgcgatgcagtgcgcctacgatcaatatggcacgattttaaatatcaacgacggcttcatggccttgctgggttacagccgggcagagctgacatctcatatccaaaatcattatatagagctggtctgcgcggaggaccgggcaaccttgctgaaaaatgtccacagacaactctgcagaaaaaatgtctttgaaacggagtaccgcgttcagaccaaagacggccgcattctttgggttttggacaaaagccagcttttggcaaagccggatggtacagagtatatcaatacgatcctgaccgatattaccaagaccaaacaagaacaggaagagctgcggctgagcatggagcggcatcggatcatcatggagcagtccaacgacattatttttgaatgggatattcgaaaaaacaaggttctttactctgcgaactgggaaaaaaaatatgggtatacgcctatttcagaagaaatcgatctgcgcattgccaactcatcccatattcatccgaaggatattcctgcctttttgagcttgatgcacagtgtctcctccggcgcaccctatggggaggcagagctgcgcattgcgaatgcagacggacaatatatttggaaccggctgcgcgccaccacccagtttgaccaaagcgggaaaccagtcaaagccgtaggcgtgattttggacatcggcacggaaaaacagcgcgttcaggacctgatcgacaaatccgaacgcgatcccctcactcatctgtttaaccgggaagctaccgagcgcaggatacagcatatttttgagaaagcggagtcggactgcaaatccgccatgatgattattgatctggataattttaaaatggtgaacgacacctttgggcacctgttcggtaacgtggtgctggcagaagttgctgcgcagatgcggctgatattccgtccgggcgatatcctttcccgcatcggcggtgatgagtttctggtctacatgaatgatatttccagcaaaaatgggccctgcaatcgggcggagcagttaattgaggggattcggggcgttttgcgggaaaagctgggcagttttgtcttgtcctgcagcataggacttgcttacttcccagaggacgcccgtgaatttcagaatctgttccactgctgtgaccaagccctgtatcacgcaaaagcccaggggaaaaatcggtatgcgctctatgataaggctatcatggagcagtggggggatttccccgggcagccgctgatgatcgcaacgacccgtattgaatctaatgaaacctacgaacaggacactgtggagacgattcagcaggtttttcgggtattgtacggggagacggatatgggacaggcaatacaaagcgttctctcactgctggggcagaagtatcaggtgaatcgtgcctatctggtagaaagcgtggaaaaaggcagacataataaggcggtctatgagtggtgcgcagaagggacggttccgctgaaagagaaatttccgcatttgccgtattacgatattcaggccaccaatcatttgcttgatgccagcggaatcttcaactgtcccgatgttgatatgctgccggagagagaacttaagctgcttcgtacccgcagcgccgaggctgtgcttggctgtgcgttttttgacggcacggagtttacgggcttcattggatttgacagtgcggggaaaaggcggtggactcagggacagatcagcgttttgagctttttatcagaatggctgtccgctttcctcatcaagaagcgtgcgcaggatagtctggcagattttaatcaaaatctttgttctttgctggatgcacaaagctcctggatttatgtggtggatccggatacctatacgctcaagtacatcaatgcacaggcacagcgtttgcttcctggcgcaaaagtcggtatgtgctgctatgagaccctttttgggcgcagcacgccctgtgggcggtgtccgatgaaggaaaagctggcctgtccggagggagcggaacagatggagctttataattctatgctgaagatttggaatttggcggaggcattcaatataaagtgggacggtgcggacgcctgtatgatcacctgtcaggacatcaccagatataaggcgtagggagaatcgcatatgtgacaaagccggtcggaggaatgtgatctggccgcgaattttgaaggaagaggtaactaaatcatggatgcaaaaaaatttcttgcggcctgtggcggggattatgaatgcacgatgcggggcttgatggggaataaaatgttgttttgccgtctgcttccgaaggtgtttcaaaatataaattttcaaaaatggaaacggggggaacaacaaagtgagtgaacgcactaaatttgaggaagcagccttggctgccgaattaggtatgtatcgggaaattgctgatgaagcggccgacactctatgcgtagtggagcagaagagccataagatcctctatttccatgaggccaaaaagttagtttccaatacggacagctgtgttgggaaaaaatgctatgaggtctttcacggacgggtaacgccttgccccttctgcactctccgggatggagtacatggagaggacagacaggtggaatccccctggggcaagaggatctatcgcatccatagccgggcgacgatatggaatggagaaccagcattcatccagctcctccgtgatgtgaccgaggaggaagcggaacggcaaaggaaaaaacggctggaagaatattttcaaacgctggtggacagtctgcccggcggtgtgagtgtggtgcgtcggcagaaggactggagcatcacaccggaatatttatcgaccggctttgcggatatgacgcatacttcgttagatcaagcttgggcaacatacaggcaggatgccctgggcggcgtccatccggacgatgtagagcggatcaaagcggaactggaagaggcctttaccaacatagatcgccactatgaactcacctaccgcctgctggacggaacaggcggatatatttgggtgcgaaacaccctgacaatgctgcctgacgaggatggcggcctgcggcagtactgctatcttcgggatattacaaaagaacgcgaagaacaggagcgaaccagggcgcaatataaaaagctgatcctgcggcattatcaggagccgggagataatacgctggtgcttgggcactgcaacattacacaaaataaaattttggaggtcaatgattttaccagctcaggctccattaaatcgcttggcacggatcgggagtcgttttttaatgccatttcacagatgatcgtggataccggggatcggaagacctttttggacaggtatctctccgctccgatgctggaggcctaccgccgaaaagaactggagcagatttttacctgcctgacccaatttccaggcgaactggtgggatgctatgcgcagtataaggtgaatctggtggaagatcctgacagcggagatctcaccggaatcctgtccgtaaccgatatcacggagcaagtggtaaccaatttggtgctgcggcgcttatccgatactggctacgaccacattcttgtattggacatattcagcaatcgctgtacagtgttttccggcactttacgtacagattgtatgccgccgcaaaacggcgactatatacaaatgatggagtatctgctggagaattgtatcttgccaaaggatcgggacacgtatcgaaagcacctggataccgtgcctatgatggaacgtctgaagaaaaacggcgcgtacagctttgattattccatggtggatggggatgggaacattagcaccaagcgcatgaccgtatttgcaattgacctgcggcttggcaaggtggggctttcccagatggatataacagaaacagtcagggaacagcagagccttttgaatatgctggcctatacgtttgaaatagcttcttttattgatatcaatacgaagcggatggtcatgcacacgcgcgagacggtgctggaagatctctcccccttgtccattgaggactgtgattatcacattcaagctggtctggccccctacaatacagctggacagaatatggacgaggttcggcagcggtttctattggaaaccatactggagcaattgaaggagcatcctttaggctatgattttgtatatgcctatcagggagaagataatcttcagtacaaaaagatcaatattctatggggcgaccggaatcatcgaaccgtgtgtatcgtgcgtgcagacgtcacggaaatgctggcagaggaacgaaaaaacaagagggaactggaggatgcgctttctctggccaagcaggccagccaggccaagactgattttttctccactatgagtcatgatatccgtaccccaatgaatgccatcatgggtatgactgagttggcgctcggccatccggaggatccagattatgtaaaagaatgtcttgggaagatctctctttcttccaaacacctgctgaacctgatcaacgatgttctggatatgagcaagatcgaacaccgggatatggagctaaatcgggaatgtctctctttgaacgaactggtggaacaggtttgcacgatggtcaggccccaggcgcttgaaaagcatcagcagttccatgtgaagatcggaaccatctcacatgaatacttttatggggacggcttgcggatcaatcagatactgatcaatattctgggtaatgcggtgaagtttacgccggaaggcggtcaggtggatttcctggtggatgaactccctgccgtgaaccgtgtgcattaccagtttgtcattagggatacaggcataggaatgtcgccggagtttcttacccatgtttttgagcctttcgccagaggtatgcgcgtaagccgcgtccagagtactggcctggggctaagcattaccaaaggtttggtggaacagatgggtggaacgatttccgcaggaagtcaggagagcaagggttctctatttcaaattgatttggaatttgaagcgggaactgcagccccgccaagcacaaacgaaaaagagcatccgattatctctaaaaaagccacagatattctgacaggaagccacttcctaatcgcggaggacaatgaaatcaacgcggagattctgcagagcctgctggaaatgcatggtgccagatcgcaattagaaacggatggtgaaaaagtagtaaaggcgttttcgtcgaacccaccggggacttatgacgccgttttgatggatatccagatgccggtgataaatggatatgaggcgacacgtgccatccgggcgcttccgcgggaagatgccggcacgatccccattatcgccatgacggccaacgcctttgccgaagatgtacagaccgcgctggaagcggggatgaccgcccatgtggctaagcctattgatctggatgtgctgcaaacgactctaaaaaacgcgctgtcacaaaagctgaggcttgaggagcgccaacagaggtgactatatgataaaacatcaaatacatggaggtatccgctgccttgccgcggcatttctatcgacacttttggctgtatctttcttctccccctgcgcggccgcagcggagtcagaggagactgtcctgcgggtggccttccccgacgcggagggttacacttctctttcaaaggatggttcgcccatcggtgtggtagtggattatcttaacgagatttccaaatacaccggctggaaatacgaatatgtctccacgggcaatgcagtgggagacttccaggatggaaaatttgatctgatgggcggaaccttttacaacgaaagtctggaagaaatatttggctacccggattataactgcggctacacgcaggcaaaactgatggccaggaaggatgacgcctccatccgcagctatgacacagggacgctgaatggaaagaccatcggcgtgtatgaccgatctaccgaaaatatccagcgtctcaaggaatggctgaccattcaagctctggactgcgagattcgctattatggccgtgatgcgcttgaaaatggaaatctatacaatcgattagagaatggggaagcggatctgttgctgggctatggaacagatataccggacactctatacacagcagcatccttcggcggtcaggcccattacattgtcacccagccaaataaccaggcgatattggatcagctcaatatggcgctggagcagatctatgccgcagacccggaattcgcagaaaaagaacaatcgaagaacttcgcggacaacctgacgggatatgcggttttaacagaacaagaattgtcgtacatcgcagaaaaaggcactgttactgtagcggttccaaatgattggcaccctatgtactgcgtggacatcgatgattatcatgaggggtttgtgccggatgtattggagaaagtgacagaatattcgggtctgcaattcacatatcttacctgcgactcctatatggatgcaataactatggtacaagagggaacagccgatatactgggcttttttatgggcactgaggagagcgcatctgatcatgatttagccagaacgactgcctatgccggcctttctccgattttggtccgaaataaaaatgtcacctatccttcggaaggcagagtatgcggcgtgatgaccggccggagcaaatcgaagtctgttgtcgcggacaaggtagtgtattaccacagcgccgaagaaggattgagcgacgtcaaccgggggaagattgatttcttctatggaatagctgcacatacggaaaacatcatacgaacaaaaaacttgaccaatgtagtccaggtgagccttccaaacagcaacacagaagttagttttgcggtttcaaagccggtgggcacaccgctgttctccattttgaataaggctgtcaacaatatgacagaatcagagaaagaagccatcagcagttcgaacatggtttccattggggatacgcatattacactgtccagcatcatcgcctccaatccccagttagcaattaccgtagtcgctctgtttttgctgttgattctgctctcggtgagcctttattttcactttcggctgcgggctgccaagatgcggttgggatgggagaaagcggaggcggacagccgggccaaaaccgattttctttcccgcatgagccatgagatccgcacacctatgaacgccattgtaggattggcagatttgaccgaacagcttccgggtctgccggaaaaggcacagctcaacctgggaaaagtcaaagcctcctcacattaccttctgagtcttatcaacgatattttagatatgagccgtatcgaaagcggaaaaatgacactcaactgttcgcccttctccatggatgaactgctcgacaatattgaaagtatgcttgccacggatgccgaacgccgtggtttagagtttcatatagagagcaacgtgcatgcggaaacttatctgggcgacagtgtccgtttgaggcaggtgcttttgaatctgctgtccaatgctttcaagtttacatatgaggacggcagcgttacgcttcgtgtagatggcgcacccgccggccagactgatcaggcgcttaccgttcaggtgatagataccggcgtgggaatcgcacccgaaagccaggagcgtgtgttccagagctttgagcaggtaggaaccagctccaccaagagtatgggaaccggtttgggacttcccatcagccgaagcatcgtgcggctcatgggcggtgatttgcttttgcgcagcgagctgggccggggcagtaccttttattttacgattacccttccttttggggagcatagtcagcagcctgagttatgcccaaaaacggatttgactctgcacggtatccggattctttttgcggaggacaatgatctgaatgcagagatcgccatggaactcttgggagcccagggagccgatatacagcgggtggaaaacggaaaactggcggtgaaacgttttgaagcaagcactcccggagaatttcaggcaattctcatggacatccagatgcctgagatgaacgggctgaatgcaacaaaagccatccgaaacctgaaccggcctgacgcccagacgataccgatcattgcaatgactgccaactcttttcaggaagatgtagatgcggctctgacggcaggtatgtctggctttgtatcaaaaccggtagatatcaatgtcctgttcagtgaactgcacagaaccattcgagcggcggaaaacacataactttggtatacagttttatcccatcctggatatgaacagatctatcaaaggggttggggcgaggaagcgtttggcggaaagaatggtacaatagcatccacatagattcgattacaaaagccgtaaagcgcatttaagttatggatgttaaatcctttctcattaggcaacgtcttggaatagttgtcaggctcgtggggattctgggctgaatcaaatttacatccctccgcagctagccggcgatcccccccataccgtctgatatgggggggagattacccaattctgccattttgtttgatcaggatgattagaatatggtctggaggacttataatactgcaaaaaaactgatcccaccttcattcatcgagtattcccatcatcggtataattccgttaaaagtcagattgaccattttttgggtcataaattcggcactatacttgaaattactttttatataaaacttaagcagcccatagtgtgctccgattatgtaattagtcagaacatccaacggaataatatcctcaaatttataggtaatggggcgtaacatcgtagtataccagtcaattccctgctgcagaatcaaggcgtcgaattctaaagaaccattaggacctaatagtaaagaaaaaagttcaccatgatccctgacatggcaaaaccagttatagtagcactcgtatgcctcgccctttttcataagcttatttggatttttaaaagaatctgataccgcttttgttaacccttcagcggtttctctcatcgtctgttccaaaaaaatattaatatcttcatagtggctgtaaaatgtagagcgattaatctgggcttttgcacatatatccgtaattgttatacagtgaatactcttctctttcaacaactcgatcaaagcattttgaattagtgatttggtttttattttccgtaaatctgccattgtaatctcccttccacctcattcggctgttcttttgttttcttcctctttactttactggtctatataattataacataatatgtctcctattataataatcaatttctcagactttgtaggttttcttggggttactcaccacaaaaaaaaggggtgacggttaaacaacaaaacttatttttttaatggtcgaaatctgtgtttttaactgttaatattaagaaaaagcaaaggccgatgcaatagatgttaaccatgtttagttattgaaaggagagaaatatacagtgatagatatttatggaattttcaagaagataccaggtggatcattgcttttcccgatgtttactgtggcattaattaataccatttttccggacttactgacctcttttgggggaatgacaaccgcaatgtataaaacaggtacattgaccgttgcgggaatcatcttgtttgcaaccggtgcaggtattaatgttaagacattaggaacagttctcaaaagatgcggtgctcttacgatagccaaatttgcaatcgctttcggttttggcactctcttcgtaaaaatgtttggtgttgacggtatctggggaattagcgcagttgcatttgttacggttatctgcagtacaaaccccggagtattcatgggattagcagcagactatggcgagcctgcggatttaggaaacttcgcagtaatgaatctggcttccatgccttgtttccctatcatgatattagcaaccgcaacgggcggagctttcgatatcatgagtgttatcaccatattagttcctttctttttaggaatgctgcttggaaatatcgacccgaattttgctaaaatgatgaagcctgccaccccaattctgattccatttatgggagcctgcttcggctcgtcaatcaaccttatcagcgctttaaaagcaggtttatcaggtgttctcttagccgttgtatttctgattatcaacgttgtaattatgctttttgtagacaaaattatcaaccggcgtcctggttactgtggtacagcctggtgcagcgtagccggtatcgcaatgacagtacccgcaatgcttgctgccgacccgacttatgaggcatacatcggcacagcaggttcacagattgcattggccattgttattacgggccttgtaagtccatttattacaaaatgggttgtggggatgtggggatcgccaaaggttccatctaataaagagaaagcagttgttattaagtcagcagctaattaaacttaatgcagtattaatatcagtttaaaaaaataatatataaaaaaggagaatgatttatgaagattatcgcagcagaagaacattttgttatgccgccaaagcctggtgcacctgcaccgaaaggattaccgccgctggaacagggcactatgctcggagctccctggttaaccaatccagcgtgtgcaatggatcttgatgatgttcgtattggtattatggatcaggatggcgtgacaatgcaggtactttccactccattcggccaggtttggccagctgaagtagctgtgcagaactgtaaggaagcgaatgattttctggcagcagctataaaacgccacccagatcgttttgcaggctttgcagcaattccaacggcagttccggaggcgtgcgctcctgagctggaacgtgcagtgaaagaattaggatttgtcggctgcctgatcggtaaccgtgtgaatggaacgaaattccttgatgatcctgagtttgaagatcttctcgcagcctgtgagaaacttgatgtaccgatttacctccatccaggagctccgccggcagagatcacagcgctgtgctattccggatttaatgacgaaatggtctccgcatactcccgctatggtatgggatggcatacagatgtaggccttcatatgctgcatatggttatgtcaggtgtatttgaccgtcacccggatcttcagatgatccttggtcactggggagaattactgccctattacgttgatcgttttgataccgctatgccgaaagaatttgcaggacttaagcataacccaagctattatctgcgcaataacatgtatgttacatccagtggtattcagtcaccggaatgctttgaattctgtgtgaaggtccttggtgctgaccgcattatatactctgcagattatccatttgcttctgttgaaggagctgataagctcttcaattgtccgagtatcagcaaagaggaccgggaaaaatttgcgcatggcaatgcagagcgtctgttcaagctctaaaagcccttaatgtaatcgcattttcgatgatagtaagaagactgactgtaagacaaattcctaaaaacctccgggctatttcagttcgggggtttttatatgcccttttcatataagatttcctatatcccagcccttatatatcccatctcctattatctgtttttccatacatcccagctttatctattagaagtttccatattatattttacatagatatgttttagtttctatgtgtttatccaaatttcttttcttttttattgtaatcatgctatactggatttaatggaggaatagatacgttaagataaataattgtttggattatacccctaaacgaatacaatgaattcactaatcaggaggatggatatgaattaccagatacgtgaaatagctgaagcagaataccctttattagatacttttttgtacgaagcaatctttattcccgaaggaacagaagcgccgccaaaatccgttacagcatcgcctgacctccaggtttatgtctccggtttcggtacacaggaggctgataaatgcctggttgcagaagccggcggtaaaatcgtgggggcagtctgggtacggattatgaacgactatgggcatatagatgatgtaactccgtcattggccgtctctgtttataaagagtaccggggtattggaatcggaaccgctctgatgaaaagcatgtgttctctgctaaaggaaaataattacagacaggtttccctgtctgttcagaaggccaattatgccgcaaaaatgtatcttgatctaggttttcaggttgtacatgagaatctggaggaatatatcatggtaaaatatctggagtgttgaccgtacgctccggatcccccctattctccaacagtggccgcagatacgtccgcgataacctatatactgtttttctctccaactgcacaaagccagcccttatcatttgtgtctattttaatatttgtaaaaccagcccgctgcaataaaatctgaatctgctcagaattatataccgtcattccttcgatgatttccgcccattgttccccttcttcatcttcaccattggactcattacaaatcataaagattccattctcttttagaaccctgtatacctgttcaaaggccttagtaaggtcgggccagtaatatatcgtctcaaatgcggttaccacatgaaacgatgcgtctgtgaacggaaggtccatcacgtctccatgcaggatttcacatcgcccagccttaattgcctcttcattcatcttcctggactcttctacactgatctgcgagtaatcaattccttttgccttgccataaacgcttttttcaagcagcgtttttatatttaccccgccgccgcagccaatatctaaagctgcgtcaccttcgtgtattgtaatgtggctgaagccccactctgccatagcgatgtgtcggctgttcatctgatgaatcatctttttcccgtctaatccttcgggcttgcatgcattctgataaaatcccatcttatttctcccaataatttattagctctaagtcgtatcataatcagcaaaatctttcaaacaggctgacaatttgtaacaatccaggcttggctgaactgttacgacaattttcattatatccatttttttcaagtttgtaaatgaatcttcttatatattttatatcagatatagtaacgggcatagtaactttagctgttaccgttctgatccaatgaaagggcaccataaaacaactggttccccagttattttacagcacccaatatattaaaacaccaaaaaactttgttgcatctatattaaaacttcagtaatttctgaagcaggatatttttgtcatacaagaacgtcagtattgcactgtcctcgatcaggtcaaaacacatttttccgactgccgtagtatatacgagagtcaggataagaaacgcgatccatacaatcaggagcgccacaaaaatccccgccagtgcgcctgcaaaacggttgagcaggcccacgaccggaagttctccgatgatatccacagcggccatcaatgcccttacgatgatgatggcaagcaggaatgtcaccagaaatgatactatttttatagccattctggatatataggaggccacgtattccggaaagctggatacattgagctcgctgtatatctcagagttattattttccagaatgatgtttttcataaaggatggcagcgccgaattctcgatctgctttatctgtgcgtcttttgggatctcccccactactttaaggacatcctctgcagtaatccccagctgttcccagtccagctcttttaggttcgccagatcgtctccgctcagcccggcaaggggggtaccgcttaaatccacttttgacagttcttctgccgagatctcaggcatgaatgcctcagtgcattttgtttctatcatttcagaaatcggcgtatatttggtcagtgcgtgtgctacgtaagggttcagtacaatcataagtacgattgtaagcacaacagataccaaagaaagtgctattctgaaaaagcctctcagatatcccactgccatacagattataaatataacgccgaccatgattaataaccagttattcatatcttctcctatttcaccagataaacgactctcagttcatcggcgctcatcaccaggtatctgtttatcccccgcgcagggatgacttccaatgcattggtctgcaggtcacctttaaaccgcatgattccgttctttgtgataatacagcatttggttccctcaaacatgatgatctcatcctcatgcattctgacgctgctgtattctccagcaaatgctttgttcatgacctgtttgcctgacttattatacaggcgggcctcgtaccccgacttatccttattcaatagcacaaagcctatgtatttgtctgtatgaaatacgctttttatttcctgattgatctccacttcctttttcttctgcggtatttcctttccctcatatatgataaaggaactgtcactgaccgcaacggatgtggtatcgtccataaaatatacctccgggatgatactcccgtcgtactcctccatacttacttcataatcggttctggatttgccttcctcgccaaaattgtagtaggcaaccctggacttcacggccccgtccttcgtggacaggtaagaaacggctagtgtcatgccgtcccgcgacagatccagggcaaggggataccccgtgctgtttagtgtggcctgatgttctacgagaatatttcccgtggcatcgtatgttacgatcattggggagccttcatttttcaggattgcacttacaattccctggctggataccgacattttttcgattgggagcgtcgtctccatttcgcccttcaggcccttttccgtgaacaccagtatggagttgcctccgctgtcccccacagcaaatgtttcttcattgacatcaatcaccggattcttcatctggcatggctgaatccactgctcttcattctttctgttcaaatatacgataccatcccggctgtatctcacgattccgtcgccgaactgggcataccggttggtgtccgaagtttcttcttcgtatgatgcagccttacgtacactggtgtaggacctgtttttcaccagcaggtacgatccgcttacaatcatgatgatcagcagcacggctatgctccatcgctttaccgcgtcttttctgtgccgctttgccgactgttttattttttccaaatccaccgggccggccagtttcaaatatggatttttcttttgcgtcatgtctgtccccttaatgcgttctttcgtcttaccaaaagattataacatcattttatggtaatagcaatttctgcccgacgtaaatcagatttccatccgtcagaccgttcattttgcagatcgcatccacatgggtgacatctccatatgttttccggcttattatcgccagcgtatcgccctgttccacgacatatacgccatcgcttccgttgacacccgcatctgttttcgccgcatcggcatcctgaccgcttttgtcagtatcctgcggctgatccgaatcggcgggagcctgtccttcatcgtctttctgtccggtatcctcctgagcatccttttgcccggcctcctgctgtagtggttcacccgatggttcattggtaactgcagttacattcccactggtctccttcgcctccacaggctgcttgtccgaggacgtggtactcgtcagattgttcaaagcggtctgcaccgatttcattttatcaaaattgttgatcgtggtgacacccatgataatgacaatcagcaccaggcacgcgctgacggcgtacatcaggtggttgcttcttttctgctgctgttgttcctcgcgggttctaaccagactgcgaaagtccttcgcagctctatcctcaacagtttccgagggacacaccccattcttctttctagtcgagatcatatagttctgcatacatggatttttttcataatatgtataatgcccgccgatttccatcaggtcattgaacttcagtgcaaagtacacctcgtccttctccacaggatctttcatgataaacaccgtatttttcttggggaacgactttctgtggagcttcaccgtactgtgttccggcgtcagcggtaccccctgatgcgcaacaaaccagcccagcatctctccgtcttcaaaatattgtttgcagtcctcgtaggctgttttccatgtatcctcgtctattacataatcgctgcccgataattttaaatcgtgcatttggatcgctccatatatgtacacatactcctcatcatctgttttctggatatctcctaccaggaatgcaccgatcggtccctcccccgctttttcgcacaactgggcgaaaaatgtatctacataatcttctacataaatcttcgggctgtcactgacattcccgatttgacgcacatttttaggaatttgtctctccattacactcacctctgaataaaatttttcataagcatagcataacgaaaaggctgaatttatcgcttggtgtcaggtgcgttcgacaaaaatactgtgaaggggtctgacccctttgcactccgttttcagaatattctcaatttttcgctccgaaagtcctgtatcctgcatgcatgttacaaagaattcccgccttattttcctgactgttaatacgatctgaatatcttcaatttgtttttcgaacatgtatttctgaactaaaattctaactcgttcatagttatgaagcctctcatcttcaacggtgtcgagaaatgacttttcttcaaacaggcgatggaatccccagaagtcttccgggtttggaaaacgggttcttaacatgttgtatgagccctcatctatgagctctgcagtttccgcgtaatattccgccgcactgctgaattcatagtcaaaagggtgtgctgctaggttaattttgaccggattattgtggatataacgcaggcagcaccagtaatattcttctgattctacgcagtcactataataacgtccctggaatacgtggccggttctgtcgtatttggcattataatactcagcatatgtcgaattgatgcgctgcatgaacctgggcaggatatcatacttggctttcatcatgatatgtatgtgattagacataacgcagtaggcatatatttcagtcaaatagtctgcctgcctttttttcaaaatattcagaaatgctatcttgtcgctgttcttctcaaatatcttttctttgttgttgccgcgggctataacatgatagacttctgttccgctctctcttctgttcttccttggcatataactcctcctctgtctttgcctgaaacgattgtctaaaatgaattttaaatatgcttactgtgaaatgttgttccgaaacggaattgaaaataattggaatggctttcgccactgatgatcggatattctaccgaacggcttattgttctgtccttaaagagtatgatcagattaaaattagaatatcatatttttcttaaattttctatgaaaaattgaaactgaatatatgaagtgttattatggatataaatttggatataaattataaatattatttacacataaataaatacttagaggtgtctgtcatgagatttcaaaataaattattgcataacctccgccgtgaggcttccgataagaaggaagacctgcgccgtgactggggggatgagttttatgaatgcattaaggatattgccgaacatcccgttgtattacgcatgaagctgtatcctcaccatggccataccagctgctatcagcactgccttcatgtcgcttattacaactatgtctggtgcagattttttcagcttgatgcgcggtcggccgcccgtggaggtatgcttcacgacttgtttctatatgattggcatacacatgctgcccggaccggagatcattttcacggaatgacgcatccaaaatgtgcttttaagcatgcgaaaaagttttttgaactaaactataaggaagaagatattatcctgagccacatgtggccggtaacgcttttccgtgttccccggactaaagagggttggatcaccacatttacagataaatactgcgggactctggagacaagccagcggtagttcaaaattcaacggggtcagaccctcctgcggagagggtatgaccccgttaatattctttagaacctaaaggaaactttttactttcttatatatactttcagcatcgagcccgtatttcttaaccagttctactgccggccctgactctccaaaagtgtcatagatgccgatcttcataacttttgtgggcgccttctctgagagcacatcacacacagcactgcccagtccgccaatcacggaatgttcctcaactgtaacgactttgccggtttcctgcgcagctgcaactaccagatcctcgtctaaaggtttaatggtatgaatgttaatcacttttgcatcgactccatctgccgacagcatttccgctgcttccaggcagtttgctacaggaaggcccgttgcgatgattgtgaggtcttttccctcacgaagcacaaccccttttccgatttcaaatttataatccgtcttatcgttgatcaccggcacggccagtcttccaaaacgcatgtataccggacccacatgttcatatgctgccttcactgctgcctttgcttctatatcgtcggatggattaatcacaaccatacccggtattgtcctcatcagggcaatatcttcgttgcactggtgcgtcgcaccgtcttcgcctacggaaatccctgcatgtgtagcgccgatctttacattcagcttcggatatccaatggaattgcgcacctgctcgaaagcacgacctgccgcaaacatggcaaatgagctggcaaacggcactttcccggctgccgccagccccgctgcaactcccatcatattgctctcggcaataccacagtcgatatgtctttccggaaatgccttcttgaatacacctgtcttagttgctgctgcaaggtctgcgtccaatactactacatcttcatgttctttaccaagttcagtcaaagcattgccataactttctcttgttgcaactttctttacttctgacataatgcttcacccactttctctaaatctttcatggcaacttcatactgctcgtcatttggagccgttccatgccaggaagcctgattttccataaaggaaacgccctttccttttaccgtctttgcgatgattgcagtcggctgcccctttactgttctcgcttctttaaatgcagcatcaatctgatcgaaatcatttccatcaatgttaattacatggaaattaaaagcctcaaactttttgtcaatcgggtatggtgagttaacctcatcaattgctccgtcaatctgcaggttgttattatctacgattacaaccagattgtccagctttctgtgcgctgcaagcatagaggcctcccatacctgtccttcctggatctccccgtcacccacaagggtatataccctgtaagcatcccctgaaagcttggctgcaattgccattcctactgctgctgagattccctgtcccagagaaccggatgacatatcaacacccggaatgtgcttcatatccggatgtccctgaagataagagccagtgtggcgcagtgtcttcagatcttcaaccgggaaatatcctctgttagccagtacggaatataacccgggagccgtatgccccttagacaatacaaaacggtcacgatccactttcttaggatccttcggatcaatattcatttcttcaaaatacagatatgtgaaaagatcagctgcggataaagaaccgcccggatggcctgattttgcactgtgaactgcagtcacaacgcccttgcggacctcatttgcagtcttcatcaattctaacttattcattgaaattcctcctgcttcataaggggtctgacccctttgcccctgtttgttaaattattcaccaaataccgctctataatctgcctggaactttgcgattcctgcgtctgtcaatgggtgatgtgtcatctgctcgatcacgctgtatggaacggttgcaatatctgctcctgcaagtgcacagtctgttacatggatcggattgcgcacgcttgctgcgatgatctctgatttgatgcctgcaacttcaaatatctgtgcgatctccgctatcaggtctgttccacgtacggaaatatcatccaggcgtcccaggaacggagatacgtatgtggctccggctcttgccgcaagaagagcctgatttgcggagaagattaatgtcacatttgtcttaatcccttcagaagaaagggctttacatgcctttaggccttctactgtcatcggaatcttaacgaccatgttcttgtgaatcttcgcaatctctctgccttctgcaatcatgccttctgcatctgttgtggtagccttaacttcgccgctgatcgggccgtctacgatcgaggcaatttctgcgattacttcctcaaaaactcgtccttcttttgcgatcagtgaagggttcgttgtcactccacagataactcccatatcgttagctttcttaatatcttctacttttgctgtgtcgataaaaaatttcatgatttgttcctccttgaacgaaaatcccttagtttctatattataattataagcgctggtaaagggcgggtcaatagcccgaaaaactattaataattttattctattaatataatcaaaatattaattgtcttttagttgttattgttcctctataatacgaccataaaatctatacacgccttttatggttgtttatatgagaaacttttatgaacgcgattgttttctatttgaattattaataataaattttatcgccgcattaatttttcttttttctgcttcggggatatgaagtcgttcctcttgtaacgatccgtggttcatactcaacatgataaatactgacaggttccatctcggaatactgtttgtcccgcgtctttattttcttcataataatatcgcaggcatcccggcctttataaattacaaagtgctctatcgtcgttaaggatatgttatgcattcttgcaaacagtgtattgtcacagcccattacggacatatcaccgggtactctgtatttttcatcataaagagcatccaggataccgaaggcaatcatgtcgttcagccccacaatggccgtcagattatgatattccgccagcagctccttagtcaggtcatacccgattctgtactcagaatcaattcccggaatatccttatcaatctgctcattggccgctttgataatcacgttttcccccaggcccgcatccttaaattctttgagaaatccctccacccgttttgagcgctgcttctgccttactgttaaaggcggcgcaatatatgccacatgcttgtgtcccagttccaacaggtgccgggccataattctgccgagcttggaattgtcaagctcaacggcatccacatccagcttctcattttgattattaatgatggcaaatggaatccgctccgacatttccgccacaatgggcataaaacatctgcttgggttgcaggtatagatcacgccctgggggttcagcgacggcatcattttcaaataacgctcttccagctcaaggttcctctgagtgttacagacaaacagcccaaatccctgctctgtggcccgggattcaatcccctgcagcagcatcacataataagggttcgtcaaattaggacaaagcacaaccagcagcttttcccgtttactttcctttttcctttttctcttaggcagttcataccccagttcccgggccgcttcctcgaccttgcgcaccacgtcctttgaaaaggaaacattatactttttattaaggaccatggagacggtggattgtgatacccccgctttgcgcgccacatctgaagatgtcacctttttcttatacatcatcccacttccttcgtacctgattcatctgcctacagttcagttctgccttccaaagcccgaaggagggtcacttcatctatatactccagatcgccgcccaccggaacgccactggcgatccggctgaccttaatccctgtaggctttatcagcttgctgatatacatagccgtcgtctcaccctcgagactggagttggtggctataatcacctcatcgacgtccccctgcagacgctccataagttccttaagccggatgtcccccggcccgataccaagcatgggggatattgctccatgaaggacatgataaacgccgttgtatttcccggtcttctcataggccgccaggtcccggggcgtttccaccaccataattgtcttctgatcccgatccgggttattgcaaatcggacaaagctcccgatccgtcagcgtgcagcactgtacgcagtaccgcacattattgcgcgcatccacaagcgatttggccagattatccacctgctcctttggcatattaataatgtgaaaggccaggcgctgcgcagacttcgcccctatcccgggcagacgggagaactcttcaatcagccggctgatttggttactgtaataatccatttagtatcactcctgtttcttcgttacatccttaacaaagtagtccaaaagggtcagacccttctgcaaaggggtctgacccttttgagcaccattgtcagaatatttagaacattcccggcattccaccgccaagtcctcccgtcagcttgctcattgctgaattggactcttcatccacttttctcagggcttcgttggttgccgctacgatcagatcctgaagcatctcgatgtcttccggatccactacttcttcctccagtttcacgctcagtacctcacgcttaccgttcattgttacctccactgcgccgccaccggctgttgccgtgtattcttttgtctcaagctcttttgcctgctcctccatctggcgctgcatcttctgcgcctgcttcattaaatttgccatattgccaggcattccgccgcctggaaatccacctctttttgccataactaatcctccactatgatttccatattaattttcttttcgatgtctacaaatgtatcttcaaagtgccgcccctcttctacatgacggacctccacttccactttctttccgatccggttctcaatcagctcttccagctccttacggtgcccttctgtgccaaccacctctgcctccagtgttcccggcattacaatcatcagccggttgtctccccccaggctcagcctggccttcttgagaaaggtgcggagcattccggaggcctcatctgcaatgggtctgaagttcttcacaacttcctggatatcttcggggatcgcgttgggcagttcaggttttgtctgcttttgcggccggccggccgtactgccgtcgctgctgacataaacaaccttttccgtaactgcgcctgcagaaatgccctgttccagcttctcctccacagcgcggatgcggtccagcagtgtatcctgctccacttccatggcgggagtacacagtttaatcagcgcaacttccagcataaccctcttctgcgttgcatatttgagctgcccggacagctcggaaaaaatacggatatagcggagcagcatatcgggctcgatcatctgagcctcctccttcagctgcagcatattctccgtagatacatcaatcacatcctctatattatcagatgttttcaccagaagcaagttcctgagataccatgtaaaatctgaagaaagctgggtcagttcccgcccctgcatcacaaggtcttccaccgtgtccaatacccttggtatatcccgctttatgatattacgcagcagctggctgaacacatccgtgtccaccgcccccagtacttccagcacattgtcataggtcagcttctgccccagatagaaggcaatacattggtccagaaggctcagcgcgtcacgcatggaaccgtccgccgctttggccacataccggatcgccttatcttccacatccacctgctctgtcaccatcagctcctgaagtctggccgaaatcgtctcgatactgatcctcttaaagtcataatgctggcacctcgagagaatcgtaatgggtatcttgtgcacctccgtggttgccagtataaagatgacatactccggcggctcctccagcgtcttcaagagcgcattaaaagcgcctatggaaagcatatgcacttcgtctatgatgtagaccttataccggccctccgtagggcggtacgccacctcctcccggatctcccggatgttatccacaccattgttcgaagcagcgtcaatctcaatcacattcatcgacgtccccgccgcgattgatcggcacatcgcgcattccccgcagggactgccatccgccgggttctcgcagttaactgccttggcaaatatcttggccaccgtagtcttcccggttccccgggttccgcagaacaaataggcatggccaatccggtttgccttaatctggttctgcaatgttgtaataatatgatcctgtccctttacatcctcaaatgcggtgggacggaactttctgtaaagcgccgtatacgacatgaatcacacctctgtctaattttatttatcccgcagcttacctagtataagccaatctaaataccttataccagttaccggaacacttcatccccgaaactgattcccgtcatcttcgcctctttaatcaggctgcaattcggatccactgtcttaagcttccctgccacatcctgaagcggcatcttagttgtctctccatttttcatggcgatcatatagccgaactcttctttcagaatcagttctgccgccgccgcacccactcttgtggaaaatacacggtcgtacgcgcatggagaaccacccctctgggtatgtcccggaaccgtaatgcgcacttctttgtccgtcttctgctgaatctgctcggccagttcataggcaatagacgggtactttctcttagccagcttctccttatattccttcttctttagctgagcatccttcttagaaatcgctccctcggcaaccgccagtatggtaaatggcttacccgctgcagaacgcttctgaatcacatcagcaatgacgtcaatatcataaggaatctccggaagcagaataatatctgcgccccccgcaacccccgcatgcagtgttacatgacccaccttatgtcccattacttctataataaatacacggctgtgtgaagtggccgttgtgtggattctgtcaattgtatccgtggcaatatccactgcgctctggaatccgaaggtcatatccgttccccagagatcattgtcaatcgtcttgggaagagtgatcacgttcagcccctcttccctcagcatattagccgtcttatgcgtaccattgccgcctaatatcacaagacagtccaggctcagcttatggtatgtatgcttcatagccgcaactttgtccaatccgttctcatccggtacccgcatcagcttaaacggctgtctggatgtccccaggatcgtaccgccccgggtcagaatccccgaaaagtctttggaagtcagcatctcaaaattcgcatagattaaacccttatagccatctttaaatccatatatctctacatcatcacgtttggaacatacgcccttcaccacaccgcgcattgcagcgttcaatgcctggcagtctccgccgctcgtcagcataccaatcctcaacataatcgattcctccttatttaagcttctgccgcttccgctgcagatcttataaactacaatcagctccaccgtaaggtgaagctgctcttactcttatgattataccccattttggataccgtaacaagaaaatattcatttcacggggtcgtttcgtggactcgtcgttactgtgcacaccttacgggcgtgcacagtaacggctcgtccaaatgcacactggctgtaccaaaatgtagacccggttttaagaaatccctggagactggatgctgtcccttcattctgcgccttattctccaacaaacctaaagctttcacattaaaaagcggccatatttatctcatttttgcacaaagggattgtaaaatcagccaaaaaaattgtacaatatgaacaagtaatacgaaagagaggacacactatgaaacagaataatatgttagcgatgattttagccgggggccggggttcacgcctgcacgaactgaccaataaggtggcaaaaccggcagtttcatatggcggtaaataccgcattgtcgattttcctttgagcaactgtgccaacagcgggattgatgtcgtgggggtgttgacacagtacgaatccattttattaaatagctatgttgctgccggccgccgctgggggctggatgcccaggacagcggagtatatgtccttccgccgcgggaaaaagcggatgccaacctggacgtctaccgcggaaccgcagatgcaatctcccagaatattgattttatcgacagcttctcaccggaatatgtccttatactgtcaggcgatcacatatacaagatgaattatgccaagatgctgtcctaccacaaggaacaccaggcagacgcaacaatcgcggtaatcgaggtaccgatgaaagaggccagccgttttgggatcatgaatacggacgaaagcggccgtattgtagagtttgaggaaaaaccaccgcagcccaagagcaacctggcttccatgggcatttacatattcaactggaagctgctgcgcaggatgcttcttacagacatgaagaatcctgattccagccatgactttggaaaggacatcatacctacgcttctgaacgacaggaaagagctgttcgcatataaattcaagggctactggaaagatgtggggaccattgattctctgtgggaagccaatatggatcttctggacaagaataatgagctggatctcaatgattccacctggaagatctacactgaagacggatataccctgcctcattatgtcggtccagaggccgatatcaagcgcgctttcatcacacaggggtgcaagatcaacggagaagtgaagaattccgtcctgttcactggcgctacggtcagaaccggggcaaaggtcatagacagtgtccttatgccgggcgttgatgttgaggagggcgcatgcattacgagggcactcatcgccgacggcgttaaggtcggtaagaatgcggttgtaggcagcgcaggaagcgagcatatcgaactcgtttctaaaaatgtaaagggggaagaataatatggataaagcatttggaatcgtaaatcctgccggcaaccacatctcagtagaaggacttcagtcatatcgcaccatcggggcattttcattcctcggcagataccgcgttatcgacttcccgatctcgaatatgagcaacagcgggatcgaccagatccaggtctatgcgcgcagtaaaccgcgttcgcttgtggaacacctgggaacagggcggcactataacatcaactccaagcgggggaagctgcgtgtccttttctctgaaaacagctctgacaatgacatttacaatactgatattgccgcattccttgagaatctcgagtgcattgagagaatgcattatccgtacgttgtcattgtaccgaattacatggtgtatacggagaactatgacaagcttttggatacgcacataaattcaggcgccgacattactctcttgtatcactccacagacaatgccaaggaaacatttctgaattgtgacctgttaaacctgaaccgtcagaagggagttctttctatagagaaaaaccgcggaacagcaaagagcagaaatatttttatggatacctatatcatgaaaaaggagctgtttattgagctgatccataaggctaaaagcctgtcctccatgtatacgcttgcacagattgtaaataatcagtgtaatgaactggatatccgcggagtatcccacagaggttattttgcgtcaattactgactttaagagctattatgacgcaaatatgtcgctgataaattataagaatgccatgaatctatttgacgaggaatggccgatctatacaaggacgaatgactcttgtccgacgcagtatttcgagacggctgccgttaagacctctgttgtgtctaacggatgtctgatagaaggaactgtggagaattcggtgatcggacggggatgcaccatccataagggtgctgttgttaaaaactgtgtgattctgcccggagcggtaattgggaaagatgtacatattgaaaatcaagttgtggataagggagcgaatttgctccatgcaaaggaactgattgcgccgccggagaggccggggtatatcaggcggggagatactatttagcggagtttgtaagagaatggggccgtcggtaaatgattgattcatactatatattgcagcctgacttcatagtccgcctcaatatgtagtctgtaaatatcatttcccgacagccccagctgtcttatctcttgccaggtaagcaggagatgttcatttgatttttctatataagatccccatcatcaaagggatctccgcattcgggacagaatttcggcggatgggccatgtcttcaggctcccagccacatttgtcacagcggtactgagggacgcccgcaggtttcttcgcaccgcactctgtacagaatttgcctttgtttacggtaccgcaggaacaattccagccctctgccgggacttgccttggggcaccgcactctgcgcagaacttccccttgttgcctgcacagccgcaactgcaggtccagccgtctgctgacggagcctggctgaccgcccctgaaggctggcctgcctggtttgtctgctgctgtcccatctgatagaggttctggctgttcattccgcccatattgtttgccatccccatccccataaatgccatggctgaacctgtgccttcattcttagctgcggactgcatggcagctgcctgagctcctgtcagatatgccgctgccatagtcgggtctctgaagactgcggatctctgcagttcctttatgtatgcctcatctttttcggatgcgcggatgctgctgatggcgatggataccatttcgattcctcttgtaccgttccacttatcggacaggatgtcctttaatgcattggtgagctccattgtatgcccgggcagtgaactgtagcggatacccatttctgatatccgtgcaaatgcgggctgcagggagttcagcagctcacttttcagctggctttccagatcccgaacggtatattcgtattcaaagtttgcacagacatttttatagaataatatcggattgctcaggcggtaagaatattctccgaaacagcggactgaaatatccatatccaggcctatattcttatctgtcactcgaaatggtacaggattcggtgtgccgtatttgtttcccatgagttcttttgtgttaaagaaatagactctctgatcctttcctgtgtctccgcccattgtaaaacgctttttaaaagtattgaatgcctcttccactccctcttcatatccgtcatagaaaatagagggttccgtggagttctcccatacaaattcccccggctccgaagagaatgccacaatctctccctgatcaacgatcatcatgcattgtccttcattcactgctacgattgaaccgttgctgatgatattatcctctccacgtttattagaacttctcctggatgtgcgcttcatcccctttgcagcgatgataccatcccccagggattcgcagtaaaaatactctctccattgatccgccagcactcctgatgctgctccgattcctgcttttaataagcccatagttagttacctcctgatttatgaatcctcacttatctcgttaaatcgttttctatctgtcctaaaatgtatttctgctttcgtccggacggttcttactttttcttcaaaggtttttttatgatactgcttgtcaaaaacacttcatctttctgaacctgcaccgatgcatctgcgtttcggtatacctctgcatctctctgtttatatgccgtatccaattttgctttcataccaaacatgtagatgaagctgataatcagtccgcaaatcattgccgggattatgtagcttacaggcgtctttggtttgggagatgttttcgactcttgttggttcttcccggttcctgccgctgttccactgtttgacggctggtaattctgactgctttctgactcatttgcgtcggcatctccgttccctgcactctgtccgcctgtctgagaattcatgcttttttcatacagcggcccaatttcttccagaaaaaccttaaatcccgctccgtactggccggtgctaagataattctgaaccacattattaaacagcggccttaaatcattttctggtataaatttattttcatatcctagttgaagaatattacacatgccggtgctcgtttcaaatatgaacataatagtgtgcctgtcatctccgataccatatccattgtcgtcacgcagtttttttgcctcagcccccatatctgcttccggtatctgattttctattaccagaactacatcggtctgatattgtgtgataatagcattgatctgctctgtcaactctgcctcttcctcattagataaaagttctacttcatcaatcactttcggctgacccgcttcctcattggctgatactggtattacatttaccagaaacaggcaaagcagagctgctataaaccgtatttttttcattctctgtccctctctcgtcatatgtattctcaataattcctatcgcaccgcaattccattcactttaagaaaaacagcagcattagtaaatatatgatcacactgcttcccacaaacgtccccagcgcgtatttccaaaacagccccctgtcgacaggcagatttcctgcaaacttgcctgtctgcccattcactgcgtaatggtatgtctggcctttatactttacgtctaatgtccatacaggcatcagggcatactttacttttccattttcacaagcaagtttgcaatacttctgcttaatagtatgatactcttttttattaatagattgatttatgatatcttcaaatgtccttttgattctttcctctgcccgtctccggcagttatccttaggcacatcatacttaagcgctttataccctgacaaataccccgcctcaaacggtaccgccttctcgatcccataaggttcaatagcttccatataggtatcatccatctcagcagagccatctacaggaacatgttcaaaaaacatatccccttttctggtaacaagatataaatctttttgagtaaactcatagtaatcgtcctgccacgtgtttatcttttccgcatcataaataacagacccttttgcccggcagctgaacagccagaaaggaacatagattccggttatttcttttatattatgcttcgactggtaaccttttagcaaaagtttctttcctttacaatgctccttaaatatctgttttacctcgtccttgttcagttggaatgggataaccaaatctggttgaaactctcctgatacctgtcccggcaggattatcggactgtcacaatagggacattttgtggcggcagtagtctcatcagcatccacatcgccgccgcaggatgggcaggtataaactttctttccatccttttcttttaccgcccattcgccctggacgccccgggaatcttcctcccaatcgaatgtatcctcctgtgcttctactgactctacaatctctgcatactgctggattatttccatatctatttcattatcacaggatgggcagcgaagcttctggatatcactgctgaacaccagactccccccacaacaggggcacttatagccttttgtactcatattgcatactcctcttctcattagtcttatttgggtaaaaatatcgtttttgctttacatttattatatcatagtcattgggaatttgatattaccctctcttcttttcttctacggactgatcctgttccttctttataggttttttcgtgatatcgcttgttaagaataccgccgttttacgagtatgaaacgacgcatctgtgttccggtatgcatccgcattactctgatcatactccgtctccggtttcctgttcataaaagccctccatattaaggtgataatccctccgcatatcattgcgggaatcaagtaaattaagggggattttttcttcggagcagttttcacatccttctgagtctgacttgtatctttggctgcgcctccgtctgccggctgcttttttccatataattctgaaagcccttccagataaatctgaaagccctcgctgtactgacccgggcttagataattagtagccatattcttaagcagctgcgttaaatcgccgccggccagaaacgtattttcatttccaaattgaacaactctacaattaccgctgtttaattcaattatgagcatgattgcgttcttgtcgtccccgatcccatatccattctggttatacagattttttgcctcggcatttaaatcagcttcctgtatctgccttttcattaccagaattacatctatttgatatttttcaccaatgccataaatctgttctgtcagtgctgcctcttctgcctcggatagaagctccgcttcatccatcactttcggcgggctggcctctccgctcgcagaaacaggcataacatttaccagaaacaggcaaagcagtactgccatgaatcgtaatttattcattctccgtccctcttccgtaatatgtagttttcatattcctaatgtcgctacaggtttatgactcagaaaaatataagaagcaacagaagatatacaatcaaagtacttcccgcaaacacccccagcgtatttttcctgtacatccccttatcagtcggcagatcacctgacagttttccggtctgtccgttcactgcaaaggggtatattttgtctttatattttacatgaaacgtccagagcggcaacaaggcatactgcaccttacctttcgtgcaggcaatactggagcttttttgaaagatagaataatactcattatggttgactgacttgctcatagctctttgaagtgagctctttatcttttcctctgctacattcctgcattcttctttggacacatcgtaccgaattgcttcataaccggacaggtaaccttcctcaaaaggaaccgctttttcaatcccatatggttctatggattccatataactttcatctttctcagaggaaccgcctacaggaaggtattcgaagaacatatctccttttctggtaaccaggtataaatctctttgggtgtattcaaaatcatcatcctgccatttttttatcttttgagcatcatagataaaagttccctttgcccggcagctgaacagccaaaatggaacataactcccagttacctcctgcattttatgcccggaccggagagcctttggcaaaaacttctttcctttacagtactccttaaatatctcttttacaccctcctcatccatctgaaaaggtataatcagatcagggtgatattcccccgacacttgccccggcagtattacaggactgtcacaatagagacaggttgtagatgcggttgtctcgtcggcatccacctccgcgccgcagcatggacagatataaagtttccttccttcttcttctttcactccccattcagtctggctctccccggcatcatcctcccactcaaatgtatccccctgcgcttctactgactctacgatctctgcatattgccggactgtatccatatcgatctcatgatcgcaggaagggcattgaagcttttgggtatcactgctgaacaccagactgccactgcagcacggacacttatagcctcttgtactcatagttcacactcctctgctctcttgtacatcgtccgtcaaacagctgctcatttcaatagaccgcatttacgatgtactcctatcattttagtaaaaatgccgctttcactttgcttttattataacatagtatttttatattttatatgataaaaacgcaaaaccgggcagtcatccgaaaggatttctgcccggttgaaatatattttattttctatctgagtctatccagttctatattgtcgtaagcccacgattccatacagtattccaattgcagccgctcccgtcacggctgccccgccccccataacctgcatccaagtattatacagctcctgttccggccaaaactgctgaaaggctgcaaattgtctgagggcctctgtcttcgttttccaaaggctgctgaaaaattcgaaatccgaccagtaagtgggcagatagtctcttcccaggccggagaacatgattcccagaatcacaatcactagcagcatgatccagcctgctgccaccaggcacttggacagaactgccggtttcctggtttttctggcgtataccgcagcggcagtacagaaggcagcgcacagcatagccagactaactgcaaatatgatttttgccgtggccgagtagaactgcccgtctattacttctttatgggatcctccaagatatacttccagcatactgacaatattctgcacggacttgctgtccggttttctttggacagaaatgccgtcaaatgcgcttcccttttccgcagggatcatacagacagcctcttctcctgataatattccggttatgcggtaggtcttcccaccagtttgaattacatttccggatgcatctttgaccccaaacagggctatagaagtcttttgatccagcaggcagacaccggtttcactgcttagaaaatacctgccggactgcagtgtttttccaaacactgcttccggctgtcccttgacactgaaacagtctgcctgctgtttcctgcccgtctgctctgcggatatctccttccggccatgattcttccacaccgcggctaaggcaagcttttttgcttcttcactgtccatcagctggtcaaaggattcctccgggatcattccctcctggtaactcagagacagataaccggaatgagtctctgccgcctgtgtgcggccgagcagccatagatccgccaaaatcagcgccgcagcaagcaataaatagaatgtcagtttgcgttttccattatccgtacctggtcaccttcttccacatatttttccgacgacacaatgatttggtcttctctgctaagctctgctatgacagcggcgttctggctgtccttttccagtacgtttacaggaacccttttggcgctctgtaccgtccccagcattccggagctttcagtaagaatcaggcagtacgtaccgtcagtgccttcatgcagcgcactcagcggtatcatctgctcatattcctcctgggactcggtctttgccgtccaggtaaatgccttgttataaacgccctcgactctttctggaagcggcgcataccagaatgctcctgcttcaccggaggcaccgctgcttgattgcccttcgccctggctctgtccctcttccttgctttggctgctgtccgcattttcgacggactcgatttttaagatgcgcttttcagaagatggcagcgtaatctcaacttctttccctgccgataactgctctttatcttccccgcttacacttccacgcagcctccagcctccgtttcccagaaccagtatctctgatccggtggtaacggcgccttcctggattccagaccgcagtaccacacaatcctgctccgcacagatttttcctccggctgcctgatactcacggagcttttgaagctcacgctccgcctgctctgtctgaacgtttaggtcctgtacccccagctcggccgcttcccgggcattggcatcatttgcctcctgggcggcatcttcccggcatgccaggtcataggcattctgggcatcctccagagcctgattcgcagactgcacttctgcctgtgcactctggagcgcctggtaaagcgcctgtttttgttcctggattcctgggtcttcttccgtatcaggctgtccggcggtctcctcttcccccggtccgccggcttctgccttgtcgtatgcagcctgtgcctctgccgccttctgttctgcctctgccagtctgttctgcgcagactgcagcgtcagggccgcccccgcagccgaggatactctttcactcccgcgggcggtaacctgctgctgttccctctgcaggcgcagcctctctacttcggcctgttgcttgtcaatggttttttgaagatattcctccctgaactgtaccagacattctcctgcttttaccgtactgccttcctttgcggcactctcgacctgctgctggggccagggaaaaagttttgtctcctgtgccggtacgatctgcccttttccttcccaggtgtaagtcaggcgtcccttttttattttctccacctggacctgtgcaaccagcatggatgcagcggctctggaaattacggtacaaagcgccatcacagccagaaatactgccagaatccgtatggcccgttttttattcttatccatctatgatctactccttaatccctgatgcaacaattccctgttccagataatcctgtccgaaaaagaacaataacagcgccggcgccagcataataatagacgcagcaaatgcaagggccgcctttgaggctgttatctgcggcaggtacagcgatagcggccagtaagcctttgtcttgagataagtcatcggctgctcgattgcattccagctctccagaaatcccagaatcaatattgcaaaaattccagcttttccaagtggcaggcccacatgcagaaagatccgcaggctacccgcgccatccaccttagcagcctcaatcatatcccctggtatggcggaaaaactctttcgcagtatgaataccggcaaagtggaaaacatccccggcagaatcactgccgtcggcgtatccattagatgtaccgaactcagcaccagatagccggacaccatagttacctgaaagggcagaaccatcagaagcatatagagaaaccacagcaccccttttcccggaaaccgaaatctggcaaatgcccatgctgcgggaactgccgtgagaagctgaccagccagtatgccgccggtctggatacacgagttccaaaacgccgtaaaaaattccggcgaatcaagcaggagccgtacatatgcacgcagtgtggggtaagccgggatcagccggaaaccagacatcccctccaggccggaaagtaccggcccgcacagttctctcaattcctgtactcccatgaaagagtaggaaaccagcaggaacagtggaagcagaatgatcaccagcaccagaatcagacacagccggacaacggctcctctcccggcggctgatttataactgaccaagctgcccctcccgcttttctctgtgatttctccataattcctcaccacccaagacacctcctattcccagcataagcagtaccgccgcggctgtcattttctggatgtccagatttgtaaaccaattattaaataaatgctgcagcatgtatatgctgtcgtggggataatcccccgcaatcagatatgcttcccgaaacacacggaatgcattgataaaagacaaaagcgctgtcacgaataccgtttctttcatctggggcatcgtgatataccgaaaacagctccaccttcccgcgccctgcacctgagcagcctcatactgttcccgtggtatggcgctcaagcctgccagccacagcaccatatcatatcccaggttcttccatatatagcaggccgtcagcacccagaatgcctgatcagaggccagccagtcctgtcccccgcccccaagcttttgaagcaggaggttgagccagccatgcctgtcaaaaatcatctggaaacagactgccacagacgccacgggcatagccataggcagaagcacaccggtctttgccgctttttgaaacataccggtattccgaagcgccaatgccgtgcacagtgatagtaaaagaagcagcggaatacagatcaccataaaccgtgcagtatttcccgctgcccttccaaacgcctcgtttagcagcaccgactgataattcctagctcctacaaatccctttccggaagcctgaagaaaagaccggcggataacatccagaaacggcaggaagacaaaccctcctactcccaaaaggcttgggagcagaaacaggtatgccgttcttatttctttttttctattctgcgagataggtatccaccttctgcgcgattgtctccgccgcttttgtggcatcaatacttccctccagatatttgtccgttgtctcctggtaaatgttccatacgatccgatcctgatttaccggttttgtcagagaatggccaagctccattaaatgatccacttcctctaccgtgggatatgtggcggatatttcaacggtatcatctccgatcctcgtgctgctcatcatcgaaaatgaatttgcatactcactgtccacctcggcggccacgcccttcatcgcgctttccataaccggaaatccatcatcaagctgtgccgactgtatttcttcggagaataaatatttcacgaaatcttccgcaagatctttcacaccgctgctctcattaatccccacaacacctaccggattatacatattctgaactgcggacggtttcacgttcagctcccgcatcatagcgtatggcagcatcatattctgcacactggatatctcttccgtggacactgcgtccggatatttcatgatacccgcgcccataatattgttaaacggcccaggagcatattcataggaagtgttgtattcttctccttcaaattccgcagcccgtgcattcacgctgattttcgattccagctccagaagctgcaccagcctggcctggtcaattttaccgtcggggtctacaatttcgtcctggtacagctggaataggaaattacggatataatcatagtctgcaacgccaaacacggaggcctccggattggcatccatataggcctggagtgtatcgatggattccagagctgcttttacctcttcgtcgccgaacaggattggtatcttgaactttacaggcatcccgtaaatatttcctccactctgtgcggtattcttcaacatctcttccagataagaatcctgtcccatcaggtcatcagcaaggtctgtcaaatcttccagcattcccttttcgatataggaatcaaccggcaggccatccagcagcagcacatcggctccgttcccgccaagcagttccgtattcaaagtgcggatatcgtctgtgctcacctcacctgctgttttaccggatgtattgaactctactttcacatcagtatgttttttctggaatcgaataattgcctgacgcacagtatcattttctgacaggccgaaaactttgagtgttttctccggcacagaaggaatactggggtcaaacacataatactccagtaggttcgttcccgctttatcctgactgtatagtacatagaaatcttctttatctcccattaccacagagacaggactatttaccggcgagcccatagctcccatactcccctccatcagaatctcgctgatgtcgtttccactttgttttctgctgattccgtcttctgaaactgtataccagttgctgccgtcgctgcaaagctgtccatgttcgccattttcctgcttcagtgtccctttctcagccaggctgccactctggtataaagtatagattccttcctccgtgttcactgccaccatcccgtcactgccctttgccattagcttctctgaattgctgaccgactggatcgtctggatctcgctgacagtttccaatgtatctggtgaaagaatcacaactttctgctggtatatatcctgcagccaataatttcccgcatcatcgaccagcagatctgctaccataggcgtcccgtactctgtctcctgctttaaataggctgcatccagcgcttcccctgcaccgccctctttcccccgggccagctgaaactgctgtgtctccatattcacactcaaaagtacctgtgtgccatccgctgtctcctccatatcaaccagatacgggggctgatcctggtataactccgctatccatttaaccggagtttccttccattctccatctttatattcgtacctgtttacttccggtcctttggacccgaacaagaggggattcccgtctttggatttagaaaagctgattccgccttctccatctttaaaaggcagttcaatatccttttctatatagcgcccctttcccgcgttatcatcttttgtatctcctttaccgcaccctgtcagcaaaccggccgtaagagccagcgccagtataaatgccagtgtttgttttattctgtttttcactgctgtacctccctttctatatcagagtactctatcaatactcttaatcatacaggcagaatctcaaaaaatcttgaaagcctggaattatttcttaaagatttttttgagatttatctgctatactatatttaatacaccagaatgttttgaaaagaggtattattatgcatatactgatcgtggaagatgataaagaattaagccaggccctccaattgcagctcaaggccagaaaccacacttctgactgctgttataagggaagtgaagctttatactatgccatgaagaattcctatgacctgattctgctggaccggatgctcccggaaattgacggtctctccattctgcgttctatccggcagaaccatataaacgtccctgttatcctgactactgcactggatacggtaaacgaccggattgacggacttgactgcggcgcggatgattatctggtcaagccttatgcaattgaagaactgatggcgcgcatccgcgcgctgtcccgccgcccgggtgtgcttctggagcatcaggaacttcacttttctgacctgagatttaccccggacagccgtaccctgcggtgccaggaaagagaagtgcagttgtccggacgggaagcgctgctgatggaatactttctgcgcaatccggaaatggttcttgcacgggaacagatctttgcacgcgtgtggggctctgatgccgcagtggaggacggcaatctggatacttatatttattttttaagaaaacacctgaaaacactgcacagccagagtgccatttctaccgtacacggccttggctaccgcctggaaggttaagtaaccgcatctggctcatttaaagccgccagtggcgaggatccagacgcccggccccattactttattggctcggatgccgtgcagcgtgatgcacggctccgagaatagcagcactggaggcacatcatgtttcataaatttaaacaaaaccttatccttttatataccctgacaacgggtttgatcctgacgctggttgtttttatggctttcttattttctgccttttcccagaataaccgccgggaggctgcatttcagaacaatttatttactctgacatccaaactgcagaccgattcccagtttacagacgcttatctggcggaaatggagttgaggaacggcctgctgatatacatagaagaaaacgggcacccgctcttttttcctggcgcctgggagccggacggcgggcgggatgccctgctggaccgtgcggctgctgaagccaaaaaagagggcatctatgaaggctcccagcccatttcctccgacctgctgaagagttctgtctttcgtattaagggtgcacactatgatacctggctcggtaatgtgatgatcatccgtacagagtcaggttataagaaaatgatcctgttatccgatgaaacccaaaaccgcagaagtatcctaaaaacagggctgctttacctgctgatggatctactcgggatcttcctgctgtatctaagcggcaggcggtttgtccgccgctctacacagccattggaagaaacttacgaaaaacagagagactttgtctcggcagcctctcatgaactgcgctcgcctctggccgtcatacaggcaaatgcctcagccatccaggatgcccccggggaaagtccccggcttctggctgtgattcaaagcgaatgcgaccggggaagcgccctcatcaaaaacctgctgcttcttgcaactgcagacagcaaaagtctgtccctgcataagcaaaacctggaaatagacgacctgcttctgcatttactggaactgtatgaaccggtcttccttgccaaaaacgccaggctgctgctggaacttcccgaagaaacgctgccttacgtccaggctgatccccagctctgtctgcaaatattcacaatacttctggataatgcggctgcgtatggactggaacaaagctccagcccgaaggttctgttgaaggcagactgcagcagcggctctgtgtacgtatcagtaactgactacggtgtgggtatccccggcgataaaaagctgcagatatttgaccgtttctatcggggcgacagatcccgcagccacaaagaacattttgggctgggtctgtccattgcagcagaactggcaaatgcccaggggctggatctggacgtacaggatacgccggggggcgggtgcacttttgttgtcagatttcatgttgtacagggataatcgagtggacggataaggctgtctatttgtagatagtaatcagatacactgggtgaaactaacaggaacattaaaatattgtaaacgaagagggatgatatccattttcgatatcatccctcttcactcgctttagagatcatgtttccatctttattttctgttttgttgatacccaacggaaggctgaaagttactgtgctttcttatgttttattgtgcagcgtttctcgaaagatgtcaagtggaatcaaaacatactcctgcagcgttagcctcccccatcaaacttataaccaattttaatttctctgcagcgccgaatcaaatgcaatattcgaaggcgagaagttcattttctttatatattccagggattctctcgccccgcattcccgttccatcccgctgtcttcccactcaacagaaagcggcccctcatatcccatcgcgttcagctcccggataataccgtcaaagtcaacatccccatgtcccaccgagacaaagttccatcccctgcgcaggtctccaaacggcaggcaggagcccagtattccgttcttaccgtttagattcacctttacatctttaatatgaacatgataaatccgtttcctgaagtcacgtaaaaattgcttctcatcaatcccctgccataccaagtgacttgggtcaaaattaatgccgagtgtttctctgaatccgaatcgttttaacagctcctccgtcgaataatagtcaaatgcaatctccgcgggatgaacttctaaagcaaatttcacaccatactgatcaaatacatcaaaaataggtgtccatagttcgtagattttctggtacccttcttcgatcattttttccgttgtctgcggataggaataccagtacggccacagcggggaacccgtgaatccagtcaccacttctacgcccatcaatgcggctgcctccgccgtacgtttcatttcctcaaccgcccattttctgattttttccggattgcccttacaagaatccggtgcaaaattgtccaggcgcggctcccattcatcaccaacgcactgccccgtcaagtgcgcggatatggcgaagcatcttaaatgatgctcttccaaagtttcttttaaaccggatatataggatggatcagaaaccgcctgtcccacatcgaaatgagcatgtgtcgccagctcgatcccctcataccccatatcttcgcataatcttgctaattctataactgacaaatctccaaactgccccgatgcgatagtaatcggacggctcatatgcatttcctcctttagtgaaaaggggtctgaccccttttgttattattctttattaaacagtttatcctgccttccctcatagggattcttaatgataaggggcttcataaactcagcaaccttttcaaccccgtccatacggctcatagtcacatcctcatgttcatagctgagcgatccgtcgaatcccaccatcgacaattccgtgatcagccttttccattctacctggccccagcccgggattctgaatctgtatgtatggtccagtgcggacatgtcgccatgcatcagtgtgccgcctaaggcaatattttgttttgccagctcagcatccttcgcatgaacatggaaaatgcggtcttttaaccgatccacagccacagcgggatcaatgagcaggtataaaatattggcaggatcaaggttatagccgagcgccggatgatagttaacaagctccagggccctctccgccgtgtggatatcatagacaaaactgttcggatggatttcaattgcaaactttaccccatattcctggaacttatctaaaacaggtgtaaaacgctccgcaaactgctcttcatattcgctccatccttctccatacggaaagaagaaaaatctcccccagttttcaacgcccggataccccacaacaatcggaacctccagtgcgtttgccgcctgggcagtccggatcagactctctgttccgtgtttgattttttcttctgccgtaccctgatatataaaatccgtttctttccccgacggccccataatcaggaaggaatccgcgtggttgctcagcgcctggatactcatcccataatcagaaaccatcttattgatatccttggcataatttcctttaataacatcgattgtttctaactgtccgttgccttcatatgcgggtatctcaagtgtttcatatccatactgtgacaccagttttaccacttcttcgagcggcttttcactaaaatttgctgtaaaaaatcctaacttcatttttttcctccttttttcggtaaaatatagccgtattacaaaaaatctgttattatcaattcagtatccttggacagaaaggcggataattagtatgtattatatcgaacgcaaaagtaaaattctcgaattactccaagaagaacgcagcgtcagcgtagactctctggccatggcttttgatgtttcaaaagaaacaatccggcgtgatctgcggcagatggaaagcgaaggtttactgacaagaacccacggcggcgctgttccgttaaccacagcttttacggttcccgccccttctccggcagaaccacctgtagacatccgcagcacttttaataacgatattaaacattctctgtgcagaaaagccgcttcttatattaaagagggggataatgtatatatcgacaacagctcaactaccgtttatctggctcaatatatcccggaaaatatacaggttacatttattacgaattcgatttcttttctgatcgaatcttcacaattaaataatccaaatctgacttttgtctgccttggcggaatcttaaatacgaacaatttatccacatatggaaatattgcgctccgtaattcacatgattattttccaaacaaggcctttttgtcctgcactggcatatctgaagaaagacaaattacagattccagtatcaacgaagtagatatcaaaaaggaaatgattcacagggcaaaagaagtgtttatattatctgaccataccaaattcaacaaaaacggtcagattttcctttccaatatcgaaaatatccaccacatcataacagaccctattgtggattcttacagccacaatttcatcgaccgttcgcatacagatattatcttcgctgaatgatcttacttttcagagctgtttaaaaccatctgcaaaagtaccgccacaataataattgcgcccttaattgcatccacaaggaatgaattcacgcccatcaggttcatcatattgttaataataccaagggtaagcgttcccagaaccgtaaaaccaatcttccctttcccaccggccatgcttgttccgccgattacggctgccgcgatggcgtccatttcatagctggatcccgatgatgccgaattcacgctgcccagtctcgatgtttccacaattgccgcaattacaactaataaagataaaattgaataagcaaaacatttcactctgactacacgcacggttgccagctcggccgctttctggttgctccccaccgcatagatgtgccttcccgttgcggtgtgctgggcaaacaaatatacaaaaaccgcacacacgatccagacaatgatgggcattggaatcacaccaaatagattcgtattcgaaatcgaaagataggaatccagcttatctcctgctgccgtcagtccgcccccattcagccagtactgtgcaacagagcggtagatactcatacttcccaatgtggtaataaatgcaggaattctgaattttgcaaccaacagacccgtaatgatccccaaaacaagcgccatgataatgcttgctgccaatgttaacacaatgctctgcgtctggttaaatatctgtataataatgacgccggtaaacgccagctgcgatcctacggacaaatcgattcctccggtaataatcaccagggtcatacccagtgcaataattccgataactgaattgtttcttaagatattaataatattattgaatgacaaaaacatgcttccctgaaatatcaccgccaggacaaacaatacggcaaatgcaatcagcgcactgttgctgccggcccatcttttccaatctctgcctttcactttcgtatccatatattcacctcatttcctatattgtcccgccggtagccgctatcataatattctcttcattggcctcttcccgggaaaactcttttcgcatttctccatggaacatcacgtatatccggtcgcaaagcattaagacttcgtgcgcttcactggagagaactacaaaactgactccctgttccgccagcttcataataatactgtaaatctccagcttcgctccgatatccactccctgcgtcggattgtccaaaatgaccagttccggatttgagctgagcgcccgcgccagcatcactttctgctgatttccgccggaaaggcttgtaatcaggtcacccgtatcttttaccttaatgtttaactgctgcacataatcatccaccagttttttatctttcttatgatgaataaagggccctcttctgatcttgtcgataatggagatcgtcgcgttttcacccacactcaagtctttaataattccattttcttttctgtttctcggaaggtatgcgattctggcctgcctggctttctgcacatgattcattttgcgttccgtgttatgtaaataaatctttccttcatagtccttattgcacccataaaccgtactcataagttcaaaacggccgtctccaagcagtccggtaattccaacaatctcccccttcccgactgaaatattaatatctttaaattcacgatcccgtgaaagattttccgttctcagtatctctccgccgattgtccggtccttgtacaattcatcgtagttgaggtcttttcccaccatataccgcgcaagatcttcctccgtaatattcccatccactctgccggactgcaccacgcagccgtcccgcatgatcgtatagctgtcgcagatcgcaacgacttcgttcaatttatgagaaataaatataatgctgacaccctgttccctcaggttattcataatcttaaaaacatgctctatttcaacgtttgtgagagccgtggtgggctcatccataacaattacctttgccttcttcatcagagcccttgcgatttcgatgacctgcttataagaagcgttcagatcagataccatggtctttggatccagattgatatccatcaattccagaatttctttcgacttctcatacatcgcttttttctgcagctttccctgcttttttatttcacatccgagaaaaagattttcaaaaacattcagatcgttgattaatgccagctcctgatgaataaatgcaatttctgaagcttgttccacggccgtcccatccacctgcatgaccctttggtccacggtaatctcccctttgtttccgggaatgatgcctgttagaatattcatcagggtcgttttacccgtgccattctcacctaaaagagcgtgaatacttcccttttcaagcaggaaatcgactccatgaagcacttcatttctgccgtatgattttacaatccctttcatctgcacaacataatcactcattttatcacctctgttctaaaaacgcctgagcagctactctcaggcgttttatgttatttttaactgcggaatttaatatggtgaatccgcattgatataatcagcaacatttgaggaatctactgtctcaggttcaaggattgtatctttctcaaattctccgccctgctggattttctgtgcaagcgcaattgcatctgctatcatggatgggctgtatgtttccgtaaaacagtgaatgctgtcttcagactggatcttctgataccatgcctgagcgccgccgccgccggaaatatatttgatatcggttcttcctgcctcctgaacggctttcagaataccaagtgaaggctcatcatcaatggagaataccgcatcaatctccgggtttgcaaccagcatatccgtcgccattttcagtcctgcctcctgtgtaaatccgtccgccgttacctggatcagtttcatgtccgggaagctcttttccatttcttccgtaaaggcctctgttctctccacacttacggagccaacgcttggggctgacatcacagcaattgttccttttccttccaggacatcacccaggtattttgcgccttcacggccgattcccgcattatcacccgccagatatgccgtataatctccggttactttacggtcaaacacaattaagttaatattagcatccataattttctgggccgcaacagacacttcgtcattatgcggcagaagcacaatagaggtacatccgagagaaattaattcctcaatatcatttgcctggtcattgacgctgtcagatgtcaggattttatagcctgacccttcctctaaccccagcgcctttacctcttcctgtgcggaatagatgcagcctgccatccagccatggtctgcagacggaagggcaattccaatcaggccgtcctccgtgttaaccgttcctttactatccgcttccttagcgtcagcttgcttattatccgattttgctgtgctgttttcctgtttcgcatccgttgccgcagaatctgatttcccgtttccacatcctatacacatggtaactgccatcgccgcgatcaataaaactgataaaattttctttttcatttccaattcctccttctatgtatgtgaaaccctgaggtttcctttttcttttcttgttctgacaagttcttcatgtgctgttttatcatatacacagcagcccaccttgctctgctgaatcagcagctcgaggcatctgtcacacaacagacagtatttaatctcatcttcttttccctctgccagtttcttcgggagataaggatcggcaaatgactggcgtccaagcccaaccatatctgtaactccattctcaatacaccatgccccgtaattcaggagattgctttcctccggtgttgttgcacataaatcattctttccgcttctaaacggtgagaagttggaaccgatgactacggtttccggtttcagcgcctttctgaattcttttgcccaatactgatgtaagtaagcataatatggaacatgtttgtcaacctgcgttaaacctaccgtaatggacgggcttcccgctgactgaataataaagttcgctcctcttgcctccaggccctggatcagcttaattggctctgtcagatccataatcggagaatccggaccctctgttccaaatcctcccgggaatccctcccaggctgagatcttggaaccgaccaggaaattgggatctggaactgcttttctgattctttcgattaattcaaaagcaaagcggcttctgttttcccagcttcctccgtatttccaatccctgctgttatgcggacggatcatctgacaaccgaggtatccgtgggacaacttcatatcaatgccgtccgcgcccgcccggtaagcaatctctgccgccgtcacgaaagaatccataattctttcaacatcttcttctgtaagcagatccccgccatatcccggcagcggattcggtgtcacccttctggaaaactccggattggaaatctccccggaatgggttaactggaagataaacagcgtctccgggtttgcttcatgcacccttctgacaaactcagtcaacggtttttcattggccggcataatcgtcagctgattatctcttgccctgcattcccttgttacagtgattgcttctaatgaaattaaccccgcgcctccttttgcaagatcacagtatctctggattgtctcttctgaggggttccctgtttcatcttctttgttgcactccatcgcctgtataaaaaatcggttctgcgcaactctgtttccaattttaattggctgtaataatgtttctttgtaagacattataatcgctcctcctttggtttcttgtttttgtttatgaccgaatattaacacacttgtcctatttttacaacaaatttgcacgtttttatttctttttgtctgtttttcacaaatatccatttctgtttttgtgtgtattccacatattttaaactataacttgcgtttatgcccgtttagtgttaacattcagtcataatcaaaaccaaacatgcttgtttttagtatgtagaaaggagaaaacatgattcatacacttactcttaatccagccattgacaaacttctgtttttgcccgaattcaaaaagaacatcaccaatcgtctgcaaagtgatgatgcttctatgggtggaaagggaacccatgtctcaatgaatctgcataatatggggatcaacaacagagcttacggtattgcgtatggtgagacaggctccaaaattattcaaatgcttgagcaatatggtattgaagtacattttttgcagaaaccagaaaaaaacagccgtaccaactatattattatcgaagaaaacggcgattgctctacgctggcttctcccggtgtttctcttgatcaggatatcatcgatgaaatcaccgctcgtctaatagaagaactggaaccagacgattcactgatcctatcgggtgacaccagcaattgctacgatccctgtgtctacaattatatgctgcagaaattaaaggataaaaaaatcaaaatttttctcgatgcaagcggcccgaccctggagaaatgcctcgatgcatcccctttcctgattaagcccaaccaggatgaactctcccagttatgcggaaaggacctgcagacagaagctgatattgtttcggccatcgaatcattatcccgctgcagcatccccattattgcagtttcgcttggcggagacggttccattgtcaaatataacgacaccatttaccgggtaatcccgccggaagtatccgtctgcaataccatcggatgcggcgactgttttctatccgggatgatctacggcatagagaaaaattatcccatcgaaaaaacgcttactatagcaacggccgtctccgctgcaaccgcagaatccagattctctgtcggtttcgatcccgtaagagcgaagaaattagccggtcaggtaaagatcactcaactcaactagtgtactggcacattgagatttagccagctattcggctgaatatcaataagacagtgaaccaaaacagaaagaaggtataaaaatgtcaaacttatcttattatgagatgcgcaaagaaatgtgcaaggtcgcaaaaatgatgtgggacaagaggcttaccaatgcagccggaggcaattttgccgtccgcgttgacgaaaacagaatcctgatctccccctccctgatgtctgaaagaaaccactgtgaaatggaaccggaagactttttattaatcgactatgaccagaacatattggaggggacaggaaaactttccagagaagggttaatgcatgtgctgatactaagcaatttcaaggaaatcgagtgcaccattcacgctcatcccttctactgtatgccttttgtcgcagaagcaaaacccatccccaatgtcacagaggccaccatgggacgcggcgaagtcggatgtatcgaatggaccaaggcctattccgaggagctttcacgcaacgtgtatcagtattttgaagaccacagggaaactgccgagaaaaaaccaattggaatgattatgcccaagcatggagtcgtcgtgtccggtccaagtatttatctcgcatacagcatgttggaaagaatcgaatgcgatgctttctgcacgatcgccaagtccttaatttaaaagcaggtaccccttatgtacatagaagagcggcatgaacgtattatcaatactcttcaatcgaccggacggattgatgtgaaaaaacttgcagatacttttcatgtttcaagagaaaccattcgaagagatttaaatattttaagcgaaaacgggctgctgctgcgcacccacgggggcgcagtattaagcaggcaggaatcggcgccgtcttcagcctctgaggcgcctgtcagcgtccgaaccgtacagaacataccggcaaaagaaaaaatatgcagttatgcggcaaaattcatcaaggatggggacaccatattcgtagacaacagtacaacctgtatctacttatacaagaatctccccccggaaatgcaggttaccatcataacaaattccatttcctttttagcggaatgcgccaaggcagttaacccaaaccatacggtggtctgtctaggcgggatattaaaaagttccaatttatccttctacggaaatattacgatgaagaacgcaagacagtattaccccaataaggcctttatttcgtgcaccggaatcgcatcaaaatcgcgtattacggactcgggagtgcaggaaatcgatataaaaagatttctggtcgaagcgtcaaaagaagtatttctattggctgacccccgtaaattccagccgatcgggcaaatcttcttatgcgaatatgccgacatcgactatttaatcaccacaaatgaggccgattacgcttatctgggattaagcgattccgaatcatccaaaatacacattgcaccataacggaggttgccaatgaatctaatagctttcgacataggcggcagcggcggaaaaatgtttctgggtaaatatacgggcggcagtatttccctccacacactccatcgctttgaacatgccgcagtatcaatgaacaacggattatactgggatgtcctcaggatctatcaggaattatgcagaggaatcaaaaaagcaatcgaagccgcagacgaccagatcgactcctttggaatcgattctttctgcaatgattttgctctggtttctccggagggcgatctggtaacacaaatgcgcagttacagggataacagaaccatccgctgcctggagcagctctaccagattatgccggaaaaagaactgtaccaggccaccgggaaccagaatgcacctttcaactgcctgatgcagctgggaacaatggttctggagaaccagtcataccttttcaaaaacaatacgcttttattcctgccggatctgctgctgtactatatgacagggatcagaaagacagagtttacgattgcatccgtcagccaaatgttcgacttttccacaagcagctggcatccggggattttaaaaaagttctcaattccaaaacaaatctttgcgcccatagcggctcccggcagtatactcgggagaacatctgaagcatttaaccgggaactggggactacaggttttccggctgccaccgtctgcgagcacgacaccgcatccgcctttcttgcctcatcaggcttgcccaactccgccatcatcagctgcgggacgtgggcaattgtgggcgcagaaacggatgccccggtcatcaacagttatggatacaaatataacatcgcaaatgaaggcagcataaaaaatcatcaccggatattaaaaaatgttatgggaacatggctgctgcaggaaatccgtgcggaatacaggtcacgaaacctggaatatacttataccgaaatggaggccgccgcccttaccgcaccgcccttcgcctatctcatcgatgtagatgatgaaagattttattcacccggcagcatgatagaaaaaatacaggattattgtatgctccgttatggaagcgctccctcttcgctcggccaaattgtccgctgcgtaaatgaaagtctggcaatgaagtatcgctggaatatcgagaaaatagcacatttaactggaattcactttgaatccgtgaatataatcgggggcggttcccagagcggcctcatgtgccagtttacggcgaacgtaatgaatctgcccgtcatttccggtcctgcagaggccacggcactcggaaatatcatcgtccagttagcagcccataaaaagatagaaacgatagcacagggcagagaactcatccggaattcttttgccgccaaacgctatacccccgtgaatgcgcaggaatgggaaaaacagtatactacattcaaaaatcgatttttatcttaacctaacgcgcggctcaccaaaagtacgccaagacgtgcttcaatattaagaaagaagggattttattatgaaaatttacagagcaggaattatcggtaccggctttataggcgcggtacatatcgaaacactgcggaggcttggaaatgtagaagtagccgcattgacggatacatgcaacgcgaaagaaacagccgaaaaattaaatattccgtcttacttttcagactacaaaaagatgatcgacagcgtggaactggatacggtccacatctgcaccccaaacaacacgcattacgaaatagcaatgtacgccatggaccacggcatcagcgtgatctgtgagaaacccatgtgcacgacaattaaagaggctgaagctcttgtcgcaaaggctgctgaaaaagggctggttaacggaatcaactttcacaaccgcttttacccaatgaataaccatttaaaaaatataataagggatggagagcttggggatattttttcgattaccggtaattacacacaagactggcttttattcgataccgattacagctggcgcttaagcgcaaaagaatccggaaacacccgggcagtatccgacatcggatcccactggatggatctggcggagtacgtgaccggacagaaaatcgtggcagtcaacgccgacttctcgacaatacacgcgaaaagaaagaaacccaggaaaaccgtactggccttctcaaaagaaacctttcaggaggaggactatgaacctgttgatattgataccgaagataatgcgaatatcctcttcaaattcagcggcggtgcaatcggaagcgctttcttctcacaggtaatcgcagggaaatcggtagatatcaatctgcagatcggaggatataaaaaatctgcggaatggcacagtatgaactgcaacgcgctcaccatcggaaaccgcgacagtttcaatgaaaccattgaaaaaggaattgcaaccgtgcatcccgaaaccaggccgctgattgcctatccattcgggcatgccgaagggttcccggacgctttcaaacaaagcttccgcagtatttacgaccacatcgccgatccgacaggctcctatgagcatgctgacttcgaagacggactgcatgaaatgattttgtgtcagaagatatttgaaagtaatcaaaggcaggggtgggtcaacatagacggtgaatagtggtaaacgctgcgttaattcaatagcaaccgttctaatttacaaagaatggaacaaagcggattcatctgctgccaccgtatagccacacccagcgcacagtctttttcctgcctgccggatgaaccaactgaaaaaccgggaagcctgttccccgcatggggcaggcttcccagtttttcagcgttcctcctctgttttaatctcaacttttttacctgtctctaaaattaagagcttcaccaggatttccgccgccttctcaagtgcatgcatggcgccaaacaccagggaaaaatcatcccccgtaatgattaccccgtggtgcgcccatatcacaacgtcatgttctcttatgtattccgtggttaaactgctgttctctttccctgttaccttccaaggaatgattgccacgccgttcgggatcaccttctcgcattctgcactaatcttaaccagctcttgagtaaacttatcacttttcagcggcaggtaataggtgagcgtaatcagattactggggtgtgcatggtacacaactctcgcattttttccgatggacttccgttctctgtgacacaacagatggatgggaagtgacagtgtgggctcaataccggtctctgcgccccacaccttgcggtatctcctgccttctttatccagctctatcatacagattgtttccctcggggcatccataatatctctgaaacttatatcctcgcacgtcactaaaaagaattcttcagctagctccgggacagacaccaaaagcggctcccattctcccggttgcaattcctccttcacatcttctacttcacgggccttcaccctgtaagaaagattccctccatgccgttcattccagttatgctcccacccatcattcgccaaacgtataaaaccatttacaaaatccgcatatagaaaattcataagctcctccttagatgatcaataattaggaatcatcactccctatgtataatctatcataactttttttaaataaatccacaactaaaattcatttccaggtgataattttgcggaatttagtgacgcgctttagtctcggcgcggatgggggcgctccataaagggatagccgaaaacctcccggagaacatccatgtcctttcaaaaacgcggccgcggacctaagaaattctaggcgggaaacagccctgaaaatggagcaccactgacacatcacgagaaatccgatgatttctcgcgctgggtcagctgatttttggattcggaatccaaaaatctctccattttccgggctgtttcccaccaagaatttctaagatccgctttgagcgtttttgaaaggacatggatgttctccgggaggctttcagctatcccttcatggagctggcgcatccaaccggcaggaaaaagctcgtttctaaggaggggcctcaagcgggggcagcgtatggtattgaattggcgggacttttatgtcccagtaggtgtacgtaagcaaggaaaacagcttccagttagtacacatctggaagttgaaaaacacgcatagccaatccacatccgctgccctggtccgggatcccgcccggttggcgagctttcctgccgattggatgagccagctttatgacagggaggccggggaggtgcaggggctgtatatgccgttgcgatatgctggagtgcgcttagtgattcttgaacagccgatgccggataggcggggaaaaacttgatctccaaatcaagtttttgctgaacccagcgcgggaaatcatcagatttcccgtgatgtgttcagcgtacccgcctatccggcatcgggtgttctagaatcacttagcagcacgggtgcatatcgcaacggcatatacagccccagcgccttcccggcctccctgtcatgaagcgtccccgtccgtcgacaagtctaaagcttgccaactaaatcccgttttagattccttcgtactacagccacatttaaattcctatagtaaattttttatgtttgtgctagaataaaaagggttttggcactctttgccagacccttttcaccaaatttagattaaatattaaggagaacaattatggcagtcattcgaccctttcagggcgtgcggcccgcaaaagaactagcttcatctattgccgcactgccttacgatgtatatgaccgggaagaagcccgggaagtagtggacaagaacccactttcttttttaaaaattgacagagccgagacacagtttacaccggatacggatatgtattcccagcctgtatatgacagggccagggacactctggaggagatgatccaggacggttctttcgtcagggatgaagatccctgttactatatctatgccctcacgatgaatggacggacccagaccgggcttgtgggctgcgcttcgatcgatgattatatggagaaccggatcaagaagcacgaaaataccagagaagacaaggagctggacaggacgcgtcatgtggatacgttaagcgcacagaccgggccgatcttcctggcctaccatgcccgccctgagctggatactatgatagcagcagtaaaactgactgctcctctctatgattttacaagcgaagattccgtaaggcatcaggtctggaaaatcagcagtacagaagatattacccaaatcgctcatattttcgagggaattgataatatctatatagcagacggccatcaccgtgctgcgtccgccgtaaaggccggactgaagcgccgcaaggaacatcccggcttcagcggtgaggaggagttcaattacttcctttccgtcctgtttccggcagaagaactgcacatctacgattataacagggtggtggcggatctgaacggttatgcatttgacgattttctggatctgctcagaagcggttttgacattactgatatggggcacgaggtctgtcgccctgcctgcaagggcgagatcggactttatggaaacggccgctggtaccggctgacggcaaatccgcatctgttttcggaagatcccgtgaacaggctggatgtatccgtcctgcaaaatgtagtccttggtccgctgctgaatatccgcgatcccaaaacagacagccggatccgctttgtaggcggtatacgggggcttgatgtacttgcagaggccgtagacaaggccggtgacggcgctgcatttgccatgtatccgacttcgatggaggaactgcttgcagtggcagacgccgggctgcttatgccgcccaagtccacctggtttgagcccaagctcagaagcgggttctttatccatcagttcgaaagatagattgcaggtacagttccattatatgaataaaaaaggagatgtaataaatggaaagaaatggcctttgctggtgcggcagtggaaagaaatataaaaaatgccacatggcaattgaagaaaaaataaagcttcatgcggacagaggcgagatcgtaccaaaccgcaaactgttaaaaaccccattccagattgaaaagatcaaagaaagcgccgccctgaataccgcggtgctggatgcagtcgcagagcaaatccacatcggaatgagcaccgaagagctagacaagatcgtttatgatgtaacaacaaagaatggcggcatccccgctcccctgcattatcagggattcccgaaaagcgtatgcacttcattaaataatgagatatgccacggaattccggataagaatatcattctccgggagggcgatatcatcaatgtggatgtatcaaccattctgaacggctatttttcagacgcctcccgcatgtttaaaatgggaaaaatctctgagcgcgccgagcgcattataaaggtaacggaagaatgcgtggggctgggcctggctgctgctaagccctggggacatctgggtgatatagcggacgcaatcaacacacacgcacaggccaacgggtactccgttgtagaagagatcggcggacacggcattgggctgcagttccatgaagacccgtttgtcagctatgtaacgcctaagggaagcgagatgcttcttgtgcctggtatgatgttcaccattgagccgatgattaatgagggaagccctgatttctttatcgatgaagagaatgactggaccgtttataccattgatgacgggctatccgctcagatcgaatatatggttatgatcaccgaggatggggttgaagtattagccaaataagatcccatttagagaagccagggccgcaaagagggcatccccctttgcggcccctttgtatgccgtagcggcgcttccttctccctcaggcatatcttctgacccttaattccaccccaatggattccgccagttccctgcttgcctcaatctcctcctccggcagtacatccactacagtcatctttacctggggaatcattttctcacacttctcggcaaattccaacagggcttcaaatgcattttcaaaattaggccgtgtaacccgggtgtactcttctttagtaggcgcattcaggctgatggatatagaatccgccacctccgccagtataggcactatatcctttccatggtacagattacccagcccgtttgtattaacccgcaccgaaacgccatatttttctttggcatacttcgcggattttaccagattctccaacgcacaggtcggttccccgtacccgcagtataccagctcctgatatccctgaaaatcaaactcatccatagccccaatgatttcttccagagaaggatcctttttatgccagagggtctccgcatccccaactccgtcctcgtggctgcgaatgcagaattcgcaccggcagtcacataaatttgtaatattagcatacacctggttcttatacgtatataaaatatcagccatctcatttacctcttaatctaaatattttcaaaccttataactgttatcgctatcagcacagatgcagtaatttctgcgtcttatcctttacacgcgccttatccagcgctgctgccagcgcaaggaagatcaccgcgcttccgccggactgcactgcgcttccggccagcgatgccagcggagccacaaaggaaccaaaaagaatcccctctgccagataatatcccgccgcagagatgaccgcggcaataaatggagccgcgatatttctgggcgccataatccggccttcccggcttgtaaatggcagtgtgatcagcatttttataataattgtggcaggcgcccacatcggtgcggtaagcagatctgccatccccccgccgatcgcagcggcagccagcgcgtacggcctaggaagaaataccgcccccagatagatcagtgcatccccaaagtgaatgtagccgccgtttgccccgtaagggatatggcagatgtaagctgtcataatcgtaatcatagctgcaaacagtccggctgctgttatttttgatgtgttattcctcatgtgtcccactctccttctctctattctgacgctgcttcgggagcagcataccaaggtgctgttcataatccacaccatcattgcgcgggatgccttccctcacagaatctgtgattgcccgttcaataaaagctccggcaagttctatactggcggatatctcgtcccctctcgccatccccgccgcaacaacggatgcgaagagatctcccgtcccggaataacttcctccgatatatggaaacgcggaaaaactcttctttcctccgctaaccgccagatttcccattttcacaacaccgtctttagcatcccggaaatgtatacccgtcaccactacattctccggccctctcttcatcaggtttgcggccatctgctcaactacaacgagcagatgcttctcatcggttaattcccggatcattctgaagtccgtatctgtcaggagacaaagctcggtcaggttgggcgtcaccacgtcggcctgaagaaccagttccttcatgaggctgcacagtttttctgtaaacatggtataaaccttcccattatcccccatcaccgggtctaccagtagaaagatcttcttcctcctgaacgtatccaaaaattctaaaatattttcaatctgccgctcactggctacaaatcctgtgtagattccgtcgaaccgggcatccatctttttccactcccgccggaaatactgcatcttatctgtatagtcatcgcaatagtaactgggataccctgtctgtgcgctcagaaccgccgtaggtagcggacatggctgtactcccatgaccgataacacagagatggcggccgtcagggagcagcgcccgaatcccgacaaatcattgatgactgcaattttcttagtcataatattccctcattcctttctgccccagctgtttacatgccatgatagcacataactggttcactctaaatgtccagttatacacattttaaccaggccactcaaatctttagaatactgtctgcatctcccaaatggttttatgtatacccaaagggcatcccgtaatgcatgccctgcgggcgggtctgcagcctagctgcagaataatgtataggaaatcccagcgaaatttactatatcacgaaaaaaggttcttccgactcttgggtacgggatttaccccgttcctgtgtcaaaagaacctgttttattttttatatgtatatccccactgcactttgccttttgtttcttcccaaagccccgcatatggcttctatagcccgatcatcccaattaccgcgcctttggatactccgtacagagcaggcggtaaggcttttcatcctcctctatttccggaaaacgcccgatcggctcatagaagcagttatcattttcatcatcattacacatggatacttctcccagtaatacggaaccgccggtctccggaacaatgaaatcatgatacatatatggagtaatcgtaatactctggcctggttttaagcagatcttcgtccccgcaggaaccacttctgtttttccgtctgtatgtacaacaacgtctgtatccagcatagatttgtcttccgctccattgtacacagtgatatatatatcgtttccgccgcggtttataatatcttccatcttgttccagtgataatgcatcggagccgtctgcccctcgtacagcattaaaagcttttccgcatacggcttgggatatttatccggcagcttttgattcccgtttcggattgtaagaagagagaatcccaccttatcaaaattaccaaggccataatctgtaatatcccatcccaggcagttgtcacgaacctcatcgtattcatgtcctatgtcctgccattcatctgcagtcagctttgcaaacggcggtatttcaaatctgtgttctgcgattaatgcctccatgtccttgatcactgcattgattcttgaacgtttcatactataaccccatcctttctatgtccaaatagcagggcgcctggtccctgctatctattattaaatatagctaacttatatcttatactctgataaaatcatttcaggcctgtctgcctgcttcatctttatccattcttcattcgtaacaaaattcaaaagtgcgtcaatcgtcgccattacgttagtttgcgcatagtctttgtagtagttgaaaggttcgtcttccccgctggacagcagtacataatctgcaagctccgagaccggagattccacatggtctgtaatagcaatgatcttaagccctttttccctggccagttccattcccagaactacgggttttgacgtgccggattttgagatcgctatcacaatatctcccggttccgcgaggttaatatggttcataaaaaattccgctgaggcttcaaaggtactccttattccaagccttcccagccggaaccccatatactttgaaacagaacaggtattcccgattgctataatatgtgctacattgcatatctttaaaaggttcacgcagttccacatggtttcggcatctattctcctgcctatcgctatcagcttctctgcatagtcgtggaacagtttttctattgccccgctgctcttcggaatcacgatgccttcgtactgctttttccccaagtctcttgccagagtaatccgaaactgataatatcctgtatatccgatatgatggcacatacgcacaactgtagcatcgcttaccccgctctgctttgcaatctccgatacattggaatccactgttttctgtgggttttgcagaacaaaatccgcgacctttttttctgctgcaaatatttctccatacttttcttttatgacatcaaggacttccctctgtaaaatattatcatttttcaaagctctctaccccatatacttgtttcgatccacgcccggcaatttcccagaggacgaccacatcttatataaatgtgtatattgacctcataactatcgttaaaatttccgagagtgttccgttattatagtatcatatatgccgccctctgtcactaatattctgttgcgcacagtgtctttatgttctctcttggcagcagttcaggcaggcccgaactgctcccttttttgcctaaaagtgacaaagagttttcagacgctcctctaagtatggctgtaacctggactgcacatactccggcagattgataatcttaaccggatccggattgcctgcattctcctgggaaaatgccgccactgcatcataatatctgcctaaaaattctgtccccaggttgaatttgttaattcccttagagaatgctgtcagcagctggtcgtccggtatgccgcttcctccgtgaagcaccagcgatacatctgtagccgcatggatctcctccagccgcgctatatccagatgcggggtgtctttatattcaccatgtgcatttccaatagaaacagccagtgaattcactcccgtctccctgcagaatttttctgccgcatccgcttttgtaaacagatcctcatttgcattatcagaagaagcggcagctcccacatgtccgatttcgccctctacacatacgcctgtctcatgggccttaagcactacttttttggtcagtgcaatattagtttccagatcgttcatagacccatcaatcataaccgactcaaagccggcccctatcgtattcataatggcatcatacgtaaaatcgtggtccgcatgcagcccaatcggcaccttcacctcgcccgccagttcctttaccatggccgcataattagcaaatcctgttgtgtgctggaccgtaacatgctccgggtacaacataaccattgccggtgtgttcgctgcctctgcagcatatacgaccgatcttgccatcgtataatccatacagatgaatgagatcaccgcagtgttgctttccttcgccatttttaatatattttctgttttttcatacattgtgtattctccttcaaatgatgtctaattttgtctgttttctttcaacaggcccggcagaagcccgcctgcaaaagaatcgcccaggccgactaccgtcggattcttcacatagctcaaatctttacaggggatacagtaaatcttctctcccagtctctctctcattctatcacagaatgctgcgctttcctttttaaccggaatatctttggtctgttcatagtcttccggcgtaaaattgtccccgatccggaagcgtgttgctgccatcgtgactccgccctccagagatgctttcattgcagctgcattctccccgtagaccagtgcccacgcggcagaatgaaccagaatcagcttgatgcccgaatggtcatagacatagtttaccgcttcttccactgcctctggatcaagtatatcaatcgacttcccaatatactgctgcagttcgtcttcattcatactcagcacatcgatctgaggcgccagctgccggtggacatagccgcggaaattcttcttcacataacatccatcctccatgactacgaccgcctcatccggcagataggagaagagtttcttcgttttctccatccggtctttcagcacgtccgtgtccagaagttctgaaaaagaacccagcaggaacacttcacacccgccgatcatcttaccgaattcatccggcaggacaggcatattcaggctgtcttcatcccgggaaatcaaaatacggttctctctgggagtcacgaaatcaatgtcatttgcctgaatcctcacgcccttatggcactgtaaaaccacgtgcggaaatatcttattctgatccggtcccacccccggcagagcccggatctttgacggcagaagccgttttacatgttcattgtagcagctggtctgcaatacgcttggataccccaggcggtccagaataattcctgcgcgggtaggggttccccccagtgtcacttcatagtcaaaatgattcgcaaactcaacgcacacctccgacgtggacggtaccatctcacatccgatgcctgcctgtaaatgggcaaggctcataatccaaattgcgcgttccgaatcaacctcgatatccagcttcagctcatccgcatggatatcaaatgccttaatctgcgcttctaccacctgtgtatcccatttcagttcataatctacacatgtatgaaagcctaatgcaattctctcattcattctgcagtctccttcggtctcataaaatgtttctttcttattatcctgaaacggataaccctctagtataatgatgcctttcctgccgcctggaacagatcaatcttatcaaaagccaccttcttcattgcttccacgcagataggctggatttggtttggctctcgcagagacgcatcctgaagaacctctctcatcttctcataataagctgccttaatatcgctggaaatattaatcttatttacgccgtgctccacggattttgcaatttctgaatccttgttagaagagccgccgtgaagtacaagcggtacgtttaccacttttttaatttcatccaaaatgtcaatacgaagttcgggcttcttatccttcggataaatgccatggcaggttccgattgcgattgccagacagtcaatccccgtcttctcaataaaatcctttgcctgcatcgggtctgtatataggatctcatccggtgctgttgtctctactgaatccgtatttcctatagtgccaagttccccctctacggacacattcaccgcatgtgcggcctcgcagactttctggcatgttgcaacatttccctcgtacggctggctggaagcgtcaatcataacagaggtaaaccctgcacggatcgccgtaattacctggccgaaagttccgccgtgatccagatggataaccgccggtatagaagaattatgtattctctccacaatcccctttaccatctccgttgagatatggcttaattcatccggatggattgcaataatcacaggtgcatttttctcctcagatgcctccatgataccgttaaacatattatagtcgctaatgttaaatgcaggtacagcaaaattattctcattcgcaacatcaagtaattctttcatgttcattaacatagtcattctcctcttttcttcaaattaatataatatatccattttccattagccctttacaccgccggaagacatgccggcaataaagtatttctggaaaaagataaacagaatcagtactggtatggatccgagtacgctcatggccatcatctggctccagtcatatgcatgctgtcccatcaataagttgatgccgatcggaaccgtacgcatattggttgtctgtgtcaatgccagcgcaaacagatattcattccatgcctgcataaaggtgtacattcctacagagaccattccaggtatcgagatcggtactaatacagtccaaagagctttccatctggacccgccgtcaatcattaccgcctcgtccagctccttggacaaggtattaaaataacccgtcatcatcaggatacaatacggcagtgtcgtaatcagataggttagaatcaatgccaaatatgtattaaaaagcttcattgcaacaatcatgcccatgtacggaatcagcagtacaatcggcggaatcgcctgcacgctgacaatcagggaattaaaaatctcttttcccggaaagtcaaacctgctgaatgcatatgctgcaaggattccgacaaacaatgtcagcagaactacgcagcctgctacaatataactgttaatgaaaaatcttaccttcgtggaatccgtcagcactgcaatataggacgataaactggctgatgagtcaataaatttgggcggccaggaaaaaatggccgaattggatttcagtgaagagcagatcatccacaagatcggaaatgccgaaaataaacctcccaaaaccaaaagaatagaaactatgaccttcgtcgattttttataacttccaaccatctcctattccctcactttcttctgctgtttcacatagaagattgcaacgaatatgcagactacgagcaatatcgtggctgccgttgccgccatactataatcaaccttctggaacgcttttttgtaaatatatatactcaccgtctctgttgcatttaccgggccgccgcctgtcaacatccagataacattgaaggactgcagcgtccagataaaatccaacattgcgatactaatcaaaattggtttcagttgcggaatggtaatatgcagaaaactcttaacacctgtcgccccgtcaattgccgcactctcatacaaatccccggaaattccctgcaggcctgcaagaatgctaatcatataaaatggataaccacaccagatgttgataaagcagatcaccgccaacgcaagctctctattactcagccactccgtattttgggatatctgcggaaaaacggacagaagatagttaacaatacccgacggctgtaacattaatttccacagaatcgcaacaactgatgccgtaaatacccacggaagaatataaataacacgggcaattgttttggttctggtcccaaaatatttggtattcagcagcatcgcaaataacatacccagaaccaaatgtgcaacaacacttatcaccacaaagatgatagtgttcgatattgcgcctaaatactcgctgtctgcaaatatggccttataatttgccaatccgacaaaatccggattctttgagacgacagccccatccacaaaagagtaaccgattaccatgcagatagggataaccataaaaacaatcattagcagtattgttggggcaagatatctgtatggcgcagttttttttgctgttaacttcaaaatcagtccctcctattatcctgttctaacttcatatgcaaaaaatcttttatgaaaatgttaaaacttctttttagaaatggggggcagggaatttccccctgctccccaatcttatttacctttaaattatttactttcctgcttcgtcaaggtacccctgccaatttgaaagcagtttagcgctgtcgatttcaccttcaagatatgtagtcagatcgtttgtcatagaagtcataacatctgatgcgttaggaaggccaataaattcattaattacatagttcttcttatataactcatagtaagactggaactgttttggtgcctcgctataatccggttcagcaacagtactgttcgggaatgctgacatagtagccgccagtcctgcagatgcggaaccatcttttccatccatgccgccaagcaggtagtttacaaatttagctgcttcttccttattttcactgttttctgtaatacctacagcccagcttgcatagcagataccgctctggtctttgtagtcatcttttacaggaatcgtagtagcttcaaaattgatgtctgtaaactggctcatagtagctgcagatgctactgtaaatgcacagttgcctgctgcaaagttacttgtcatctcggactcttccagtgtgctcatacctggatataaggaaccatcgtcataaagtcctttgaacatctcagcgagtgccgccagaccagcgttgtcttttgtcttgtatgcaccgctgtcatccttcaggctgattcctgatccccagccagttcccataaagacattctggataccgtttgcgtttgttgtacccaggttcaatgcaaatgcggattttcctgctgctgtaatcttcttgcaggcatccctcagttcggtccatgtggttggaatcgcttcaactccggcctctttcaggatgtccatgttcacatacattggatatgcaaaattcagaaccgggacaacatagctggtaccgtctactttccatgtatcgcttgcaagactgctgtctacgccagcgtcttcagcagcagtcagaatacccatatcaacaaattctgaaagccatgcgccgtctacactgatgatatctgcaatggtaccgttcgttgcgcctgctgtaatagctgtcttggtgtcggcccagggtgctgttaataattctactttcacgcctgtctcttcttcatatttggcacaaatatcatccaaatatccgtccgggagctctgccccccaccactgctggaacttcagtgtcacatcacttttagcgtcggacccgccttcatcagcttttgcttctgtcttggcatctgcttttgattcttccttgcctccgccgcatgctgccagacttaccaccataatgcccatcataccaacggcaagcccctttttcatgatcgtactcagtttcataatgactcctcctttaatatttgtgcctctatgcatgtaatttattttcatgggttgctggatttcatttcttttagtgccagctttctttcatcatgcatgttcggctgttatattgtgtaattttattttatcacaatttcacaataagtcaatattaaccatttaatcgatttaatctttgtgcattattcacaatcccgttatatttttaacaaatatttatgaaataatttttctccgattttagaaattttatttcatgcctcggatttattaaccggacaatccccctgtttttccctcttttaacacactctcaatgccttaatctctgaaaaagtctcaaaaatgacaaacaagagaatatctcacgaatatttctgcgtgatattcccttgtacattatttctaatatgaaaacaatcttcacctgcaatacttctcagccaagcattttattttccgaaacacaatagatcacaaatacgttctgcacttatatagagcgtcccctatcttcctaacctcacgatcatacgtaaataccccattcacttcttcttccacatccgaaagttgtgtatagacgcttgcgcacagtccttcggggatcaacgcttccacctctttttccagctttttatacgcccggttgagctttcctctatccgtatatattccatatccatactgagtcaggcaggcgctgtggccctcctgtctcatcgaatagccgccgtattcagacagaaccacagcccttctctcctccggttttatccgaagcttaaaaaaataattatgaagactctggatatccccgcctccctggtcgaaccatccgctggcctggtcaatcagacgggtgggatctgattttctcaaaatctgcgtcatatccgcagtctggaactgcccccatccttcattaaatattacccatacagcaatgcttgggtgccccttcagccgctctgccgtctctttcatctcctttataaattccagacgcccttctttcctttctctggccagaagcctggtgtacacatccctgattttccggttcctccaggacaatatggtggctgcataggtcacaaaccacggtttatacttcccgcccccattcaccatgtcctgccacacaaccatacccagccgatcacagtgataataccacctctggggttcaatcttaatatgtttgcgtatcatattaaagcccatatctttcatggactgtatgtcgaatataaacgcctcgtcggatggcgccgtataaagtccgtccggccaatacccttgatccagcacgcctttctgaaactgtactttatggttcaggcagattctgggtactccagtctggtcaggctcaattgtaaacgtccgcatagcaaaataactctctgccctgtcctcccccaattccacggtaaaatagtaaagaaaaggctcctcacatgtccacggacatacctcaggcagagaaacctcaatcccagctcccggcatcccccgcgcactgccccagtcctgtatttcctggattccccaatctgtcacgtcgccgggcgcacacataggactgctatataaccccggctttctgacacggatttcaaccggaatatccgcatttgcctccaccgtaatccgtaccttttttccgtcaaaatccggctctgcatgaatactcagtatatactgttccggcacgtcctccatccaaacggtctgccagatcccgctctgagccgtgtagaacatgccgcctctgtccagcttctgctttcccctggcatgataggaagtatcgctcagatcctttacggccagcacgatttcattttctcccggttttaaatatgtcgtgatatccgcctcaaaaggcagataaccgcctgtatgccgcgcggcccgcctgccgttaataaaaactacacaggactgatccaccgctccaaaatgaagcagccgtctaccggccttcctgccggtttttgtctcttcgctaacccggcagtcatccggctgcggcatctcaaaggttctccggtaccaaagatattcatccggctgaagctgcctccccacaccggacagaacacattccggagaaaagggcaccagaatatgtccgttatattccgacggcatggaaaaagcttttgtaaaagcgcattcccattccccgttaagattgatatagctgtcccttaccataaggggcctcggatattcctccagcacatgctccctgtcaagttccttcccccatttggtataaagttgtttcataaacatcctcctttcaacggcacaatccgcacaccatgatatatgtctgcagcatcgcagcgtgtgcatcccctggagggttttatataataggaaagttccgggcacttttctattatataaaaaatcccttagattatatcataccactaatctaagagattttcttccttctgctttaatcttcacgttttgttctcataacaagcgccgaatgccgtcccatattcagcacgacctccccgctgtggatcagataaacatccggctccacggtatagccctcctcgtaactgtagagcaggcgttccatcctgcccgtcacgggcacttccgccatccagaccggaaccgtaacttcccgcagctctttgctgttattgaggactaccacaatctgctcatcctcctggaatctgccgtacgccagtatattatccgcccagtacagcatccgcagcgacccctgcttcagaggcttctcgctcttatgaatgcggatcatttccttatggaattccagcatctgacggtcttcttttccccatggatatgtccgtctgttatccgggtccgtaaatccgcagaggcccgcctcatccccgtaatatatggtaggcgcaccgatccatgtcatctggatcacaactgcttcccgcataaccgcatggttgaccccttcctctgctgctcttgagcctagatgctccactctaccgacaatgtggttggtacgggtcaaaaaacgggaatggtcatggttagacagttcgttcatcgcaacctgcagcgacggtgtcagcatggtggccataaaatgccgcattgttttcacaaagttatcgccattgccccagagatctgtacgccgctcatcgctgtgcttctccattccggtcagaaaccatgtcaccggttccataaatgcatcgtaattcatgacgctgtcccactcatccccctgcagccattccgccgggtcgccgtaatgctccgccagaatcagcgcatccggcctggccttcttcacttcctgcctgaaccgtttccagaacatgtgattatactcgttgctgtacccaaggtctgccgctacatccaggcgccagccgtctacattaaatggaggggagacccatttctttccaatatccatgatatactgctccaacagcggagaatcctcgtaattcagtttgggcagcgtatcatgcccccaccatccgtcatatgcatagttgtacggccaggcagaatcgctttcattaaagaaatgaaaaaatgagcggtacggactatcccaactgacaaacgcacctttttcatatccttcctgctgctcgtagatccgctctttatccatccacttgttgaaggaaccacagtgattgaataccccgtccagaatcacacgcatcccccggctgtgcatagcctccaccagatcgataaacagctggttggaggcctctaggttcgccctattaccggtgcgtttctggtatttggtggcctcgatattatctgcggcccactccggaagaaccagccctccgtcttctgcaatcttcccatagtgtggatctatataatcatagtcctgtatatcgtatttgtgattggacggcgagacaaacagcggattaaaataaataacctccacgcccaaatcctctaagtaatccagcttatccatgactccctgcagatccccgccgtaaaatctccggatatccatggcctgaggcagctgatcccaatccgttactttctggcacggctccccgatataaatatattcccagtcctccacatcgttggactcatcgccgttaaagaatctgtcaacaaatatctgatacatcacagccccttttgcccaatccggcgtagaaaatcccggaactatgacaaaggcgtagaaatccataatctccttcgccactccgcacctgttaaaatagcaggtctccccatcttttttcacctcgaagctgtaggaaaatggttcgttccccaactgccaatctatctcataataatcaaactccccacgggagtctgtcttcttcattttaaacccacccgttttggttaaaatacaaacttcatctgcatcatcctttgccgttctgaacttaagcttcactttctcatactcatcaggctctgcaggaatcacatagctggacgttccatcacaaaatagtgcgtccttattcataaaaaacctccttaggggcaagccctccctcctctggaagtacttgccccattactcttctactctccaaaaagtgcttcgaattcacttctcgtaattttttctttttccaacagcaaattagcacaagcctgtaatacagaatcgtattcttttagaatagatcttgctttcaaatagcattcgtcaatgattctcttcacttcttcatcaatcgtgctggctaccttctcaccgtagcccctggatgtgtgtccaaaatcccgtccgataaatacttcatcgctgtcgttatcatagttgatcagccccagccgctcagacataccaaacttcataatcatggaacgggcaatcgccgttgcctgtttgatatcctgtgatgcgcctgtggtgatatcgtcaaacacttcctcttccgccacacgtcctccaagtgacaccgtaatctcctggagcatatgcccctttgtattgaacatatcgtctttttccggcagaggcatcgtataaccgcccgctcctcctgtcggaacaatggatacactgtaaacaggccccacatccggaagcacatggaagagaatcgcatggccggcctcatggtacgcggtaatcctgcgctctttttctgaaacaatacggctctttttctccggcccgattccaacttttataaaagcgtggcggatatcggactgctgcaggaatactcggccctcttttgcagaaaggatcgccgcctcattcagcaggttttccaaatccgcgccggtaaatccagccgtggtctgtgcaatctgcttcagatccacatcgtctcccagcggtttattctttgcgtggactttcaggatttcctctcgtccgcccacatccgggcgcccaacgattacatttctgtcaaatcgtcccggccttaaaattgcgggatcgagaatatcttttctgttggttgccgccatcacgatgatgccttcattcacaccaaaaccatccatctctacaagcagctggttcagcgtctgctcccgttcatcgtgtccgccgcccagtccacttcccctgcgccttgcaacggcatcaatctcatcgataaaaataatacagggggaattcttcttcgcatcctggaacaggtcacgcacacgggatgcgccgacaccgacaaacatctccacaaaatcggaacccgagatgctgaaaaacggaactccggcttcccctgcaacggcttttgcaagcagcgtcttaccggttccaggaggtccctcaagcaggacgcccttgggaattcttgcaccaacctgaatatattttttaggagacttgaggaaatctacaatctcttccagctcctctttttcctcttttaaacctgccacatccgcaaatgtcacctttttgtccgtatccgtggtcatctttgcgcggctcttgccaaaattcatcgccttggcattggccccgcctccctgacggttcataaacataaagatcacggtgattcccaaaaatgtgatcagaagcggtaccagtatggttgtaaaccacgaatcctggggaacatccagcagtttatactctattcccgctttatccagaatatcctgcgtcttctctacatcagatgtagtaacttgttttacagccccgctgtccttaagcgtcacggtcacaacaccggtgggagcggtcttattctgcttaatgataacatcctgtacatttttatcttttacttcctgtacaaagcgctggtttgtcatctcctggtctttcacctggaatctgtttgtaagccacagtgcaaggaagacaatcacaataaatgtaagaaatgtcgcaccgcccatgcttttatactttttgttgttcaatggtgtgtactccttcctattctactccttccaccacacctatatatggcagatttctatatttttgagcgtagtccaggccatagccgactacgaattcgtccggtatctcaaatcctacataatctactttcacgtctttttctcttctctcaggcttatccaggagcgtgcacagatgaaggctctttgggtggcgctgtcttaacgtttccataagatagtacaatgttcttccggaatcaatgatatcctccacaatcaggacatcctttccctcgatcgactcatccaggtctttggcaatacgcactactccgctggatgatgttctgttaccatagctgcttacactcatataatcgatggataccggcacggtaatcctcttggcaagctcgcacataaaaaatgcgccgccctttaagatgcagatcaaatgaacctgccgtccctcatagtctttgctgatctgtttccctaataattcgattctttcgtcaacttctttttctgatactaaaaccgtaatcttctctgacatcacttttttcctccgttacttttatctccagcacccggtgcgtctgcacggttatctggcaggcactgctcatacgataccccaatatccatataatctgcttctcatctgcaatcaacggaacacagtcccgctcttcggacggtatcttctcattaataaaataggacttgatcttctggctccgtccgtctttatcaatcacaatgctgtcccgtccctgtctgggcctgataatcaggtcaccttttattatatcatagtcaaaccatttcgtgtaggttttttggggtgcttgttttgccgaaaaatcagcttgtttttccagtatactacagcatatcgtcagattcagttccggcaccctggtaattcccggtacacgtaattgtataggggcaaaaccctttttctgcatatctgttttcttcttcagcacaacaccgtcataattcctgacagccttcactgaatatggcaggtccctgcttctgccggtctgtttctcaaacagtccggccacagcttccacatgcgccatggtaatatccctttcggctcctgaggccctgctcaggcatcttctgatcagaaggccctgcagcacccggtgaagcttccggtatccggcttcataaatacaaaggctcccgtccttttgcttggcaacgcagttctggcaggcctgctccgtctgcatctccatataatcctgcagcccgcgtatctgctccatcgcctcattcatatggcgcacggcctgcgcattgacctgttcttccagaacagggatcacctgatggcgcagccggtttctcgtatagtcatcctcctcgttcgtctcatcctggcagaacccgcagccaatctcctctacaaaccgctcgatctccctgcggttcaggcagagcagcggacggatgatatttcctgccacaggctgaatcccgccaagccccttcagcccggttccccgggccagattcataaggagcgtctccgcgttgtcattctgatggtgggccatagcaattttagttcccccgcacgcaagcagagtcctctcaaaagcctctctgcgcacaacacggccagcctcctcaacagattgtttccgttttttggaaattgattccacattttcatgataaaccacacattttacatcctgtttcctgcacagttcctgcacaaacacctcatcgcgcttagcattctccccgcgaagcccgtgattcacatgtacagccacaatctcaatccccatcttctcacgaagttccagaagcacaaaaagaaggcataccgaatccgctccgcccgatatacctgcgacaatcttatctccactcacaatcatctgataacgctcaataaaccccaaaaccttttccataagtaaactataactaatttttgagggaaatgcaagggggagtacgcctggctgaaatgaggaggaggatgccggggaagaaacgggtaagggcacgggaagtgacccgcttacggagaagtactaacaccaaagacaccgcccgcgggggcacgtacatcatgcagcgagaaagcttgatgctttctcgccttaggatgtactgggaagtgattttggaaaatcacttcccatcccccgcgggcggcgtctttggtgtaagtacttctaaaccgtgcgctctacacttcccgtgcccttacccgtttcttccccggcatcctcctccccatttcagccaggctatgttcatccttttacttaaaaaattagtttgatggggattcactggcggggccagtgaatcatcttggatactcagcaataatccaccccagcccgaaccgctccgcaaattctgcagccatccgccgcccccgtcagtgcgcaacccgcgaagcgggcgactattacggccggatgcgccaagccttgggaaacggacatagcggcgtctggaagcatgggatggctgttagctggaataaagtaaaaaagcaggaaaaccggggtaatttttgtgatttcgaatcacaaaaattcctggacccagcgcgggaagccatcagggctttccgtgatgtgtccaggctgccccggttttcctgcttttttacactactccagcttacagtcatcccccgcttccagacgccgctatgtccgcttcccaaggcgccccctccgccaaaaacctcctgctccccctagcactcccagaggccgactaccaggactgtcatgtcatccatgggcgccgcgtccccgttccaatttagtacctgttcgaggatgtgatgtgccatttcttttgggttattcatggcggttccctgaataatcgtctccagcaggatgtcctgctctcctacggggagggcatccatgatgccgtcggttaccatgatgacgaaatcgccgtcctccaactggcgttttactgaatctatttcgatggtgtgcaggacgccgattggaagactggtggaactcaggtgttctaccttgtccttttttttgataaaggtagaggacgcacctgcttttattaattcacaggtgcctgtatataagtcaaatacactcatgtctattgtggagaaatgaatttcttccctccccatgaccagggttgtgttgatcatctgtatggcggttttttccgggaaaccggcttccagcagctcctccagaagctcaattacgagcgtgctttcacggcacgctttttctccggaacccatgccgtccgataaggccactccctgacggcctccggacagctccatcatcatgaagttgtcacccgatatctggctgcagccttttccaatccgcgcaactccctgcaatgtatagaatgccgggccttccatgcatactacggtcgtatagtctcttcccagcatctgacagtgtgccccgtccagtacgaaccgccgccccatcacttctgatacgcccctgaccagctcctttgttgtgacacattcattctgcatggcccgggcggttatatgcacctcgtactttccttcgcggttcataaaaaagttcgtgtacaatacccgtattcctttccgtttcaggtgcgcgctgatcttcttctccagacgctcgtcagtaaacatgctgtcctccagctctttcgccgtactgcggatcatatctgcaaatgtatccatctgaacggcgcacccttcccggctctgggcaatcctgttaatccagatcatattctgccgcgcttcatggaaagcctccagcatctcccgcaaaaatctgggagccataatacacctttgctgcagctttctttttgtctccgtgttcagttcattgccataactgtccactgccgacagtatctcgtatcccatctggtaggtgtggacaaagttctctccccagcaccaggaacacttttcacagtttttgcagacctttcctttcactttctcgaacatttcctctatttcttcgctactgaatgtttttttcttttcttccagttttaaaaatgtgtgggacagttgtttcagggaatctgcaaatttttcaatctgggccacataggggctggaatgtaatacttgtccttcttccatgctttcccctcctattcttcgtattttctacaaaacataaaaatgagtttcgtttcagaaaccaatctctgcggcatctgccatattgcgcatctcccccgccggcttatcgcaatacggtatatccgctggaatattctataccacgacaaaagctccaggaattctcctggagcttatctttcgtagtattgttattgagccggtttaaatataatctcattggggtcaacaagacccagcttctcttcagcaacttcttttatgtactcgtctgtcttaacatactcttcgtattcttttatctcttcggcgcgctctttctgctcattgatctgagctttcagctctgcctcctgttgcttatagctcttgttcttggcctgcagggtcactgcattcaccgtcagcacgcatcccagtaatactagtatcatagtaattaaggctgcactgcgccgatggtaaccaaaaccagaactccgcttacggcttttgcgccgctgtgtccctgtagatttcttatttgccattcatactcacccaacttatcatcttattaaacacccctgcttaataaattcattctatcggtttttctttcttttttcaaggcttttcttcattttcccgtatatttttttcgcaattgagagtatgaaattcgccagcactattccgcatacaacacctagtatgaagaaccatcttatgctaccatatgttgtcatatacatctgtcggaacagatacacgctcactccgagccaatacaacagatcttccagatttacaaccacgatatggtgaggtatgaggcgcctcatcagcctgagtatctggtagctgaaaagtatcactatcccggacagccccgcgtaaaaaaatataatcgcttcttttccgattcccagcatcataggcgtgcctacttaaacagttttgcgaaaaaattttcattctgccggccggcctgatttacgctggaatatgcaatgctgtcgatattgcctgacagatccacttctcccttttctacgctgagacggttcacatgcagatcggttcctttaaccatcaacatgccctgttccgtctccagcaggatttcatttaaatcaaaagaaagaacatccaggacaccggtgaccatacttgtctttctgttatttacaacgagtttatgcgccttgggcatttgccgctcttccatacactttcccccttcaactttgcttttctatagaactcttcactatatatatgaggggttgtatcaaaatatgtatgcccgtggaagatccctggcgcttacgccggctgttcctttttacagataccggaacagctcttttgcttcttctttttttgtggtgtcctgcagctgaagcacctccgccttcacagtcttggtgccaaattgaatctcaatgatgtcccccggcttaacctgcaatgatgctttggcaacatttccgtttacaagcacacgccctgcatcgcaggcttcattagccacagtccgtcttttgatcagcctggacactttcaaaaacttatctaaccgcatttctttttcctttcttgcttatgaatagatttcatgttgtctcactttattttcattcatctgtatgcttcttactcttcaaagagaaaagaaagcacttacaatgcgtacatcataagtgctctctgtatgtttatctcttattgatccattacaattaagcgttaacttcatcctttaaagccttgccagctttgaacttaggtgctttacaagctgcaatcttcatagtcttgccagtctgaggatttcttccttctcttgctgctctttcgcttacttcaaatgtaccaaaaccaactaactgtactttatcgcctttttttaactgatcggataccacatcgatgaatgccttcagtgctttttcagagtccttcttggagatttctgccttttctgcaatagctgctactaattctgttttgttcatggataaattcctcctctttattgtactagaatataatattctaacagtttaataaaggcgctcatgtactggcgttcacatgatcaacccttaagtactgttataactgtttcccatatttttgtcaaggatttttccggcattcccgcgtttttgggcacttttttaggcttttttaacatttccaaggctcggtttccgattggaaaattatccctgacacgatatgttacatcatcttgtcaatcattgcaaggacttctttacccattttttctgaaacagcatctgcatcttcaagagatgtcccctttacaccgtaatagaacttcaccttcggctctgttccggatggccttacacacagccatgcatcgtctgtcagatcataatacaacacgttggagtttggcagaccggttgctgtgacttccccagtcgccatatccttgatggtatctgccttataatctctggccttgaggactttatagcctgcaatctctgtcggaggattcctgcggagcgtctccaggatctcctggatctttgccaggccttcgatccccttaagcgtgatggactggatatcatctttgtaatatccgtaacggtcatacatcgcgatcatcgcatcccacagattcattccttttgttttgtaatatgctgctgcttcgcagagagccattgtagccacaattgcgtccttatcccttgcataggtaccaatcaggcagccataactttcttcaaatccgaataaatactctcccttaccacttgtctcaaacccgagaatctgctgtccaatgaatttaaagccagtcaggacttctatcaggcctgcgttgtaatagttagcaatagcgtctgccatattggaggtaacaatcgtcttaatcagatatccatcatccggaagtccctttaattctctgcgctgcccgatctcataatccgcgagcagacagcctgacatattccctgtcagagtatgatattccccattcttgtccttcacacggacgccaagcctgtccgcatccggatctgttgcaagcacaatatcagcatcgatttctttggccagtttcagccccaggtcaaatgcctccgcagcttccgggttcgggtatgatacggtagggaattcgccgtccggcagttcctgttcttttactacgtaaacattctcgaatccaagctcctttagaatacggcgcgccggtatgtttccggttccgtgcagcggactgtacacaatcttgagttctttgccgacagcatcgatggcatcctggtgcaatacctgctttttcaactctgcaatatatgcatcatcgatttctgcaccgatcacttcgtaaagtcctgcagcctttgcctcgtccagtgtcatcgtcttcatggtagtatagtcttctacagcctttacctcatccatgattcccttgtcatgaggcggcgtaatctgtgcgccgtcttcccagtatactttgtatccgttgtattccggaggattatggcttgctgtaatattgattcccgctatgcatcccagtttcctcactgcaaaagacagctccggagttgggcgcagggattcaaatacataggacttaatcccattggccgccaggcagagtgctgcctcattcgcgaactccggtgacatccgtcgggaatcataggcaaccgccacaccctttgcggcatttccgctctttataatataattcgccagcccctgtgtggcttttcttactgtataaatattcatacggttagtacctgcgccgataataccgcgcaggccagccgtaccaaattcaagatctgtgtaaaaacgttcctttatctcattttcatcttccctgatactcgccagttccgccttcgtatctgcatcaaaatatgggtttgacaaccactcattgtatctctctttgtaatccatactggtacctcctgccttaatagtatgtccttattatacaacaggcgcctataaaatgaaagtaaatatattttctaaaaaccgcagtttttcttccgtctgggtgatagctgtctgtaatttttccacatttttttccggaatccaagctttattagaatggtaatatgtgttcgcagtcttccagaatttctccgggtaggcaaggcacagggcgatatattctaactctcttgggtccagctccctgatactttgataggcatccagcatagactggccaagggcttcctgccactgatgtttttccatgactttccgcagaaaataatagagatcctgcgcctgcacatcaatcctgaaatgctcaaaatttgtcgttgccagcccgtttgaggtcagcaggacgttatgatagttgtaatctccatgcacaagcctgtgatgttctatgctttcctggtacaagctgtcgtatccggaatttttcagtcttttgaccacctgctcagcctgcgagtacatccgatcaaaatattccagaaatagaaactcaaatgagccttttgaaactttattacgtataaatgcgcgcacttttttcagttccctgttatggcgcacaaactcttcctgcagatgccggcccgttggcggccgtatcactgcttctttttccggatcacacaattcctgccactgcatcctgcaatgcagatctgccaggttcctggatgcctgcaggatctcgaattcttttttaacatcacattccctgccggaaaaccattttttcagcatgtacctggaaccatcccgggatacgctgaccagctggccttctttattatagaccgggatatccacattgggatatcccgccttttccaggctgctcagaacggcataaagcaaaggggcacgcctgtctgaaacgtccgcttctttcaacagcatagtgccctctttcgtgtcgcaaaaaaacgcaccccttattttgcgggtgcctttcacttctatatcatattgttccaagacttctaattcatactctctcatggctgccccctgattctacgattctgactctttctaatgtatgaaagggacagcccgagtatgctatatgccttgtttttctttgacgtaattacataatttttctttctcgttcatctccggtttgtccaataccagctccaacagctcattcaacatatctcccatctgttttcctggctgcatgccgagatccatcagatctcttccactgaccgcaagctgcctgagagtcacacagtgatcattgataagcgtttcctggtatatttcccgcatagccacaatattttcaatcttggcacggcgcttgtatgggctctgtgccttcacgtctgccatgcgcaccgccagataataaggaaagagttctaccccgatccgattcatcgcccggcggacattgggcggagtggcttcgatccggtaatcatgatagcagacaagcctggtcacctttttcacggtgtcattatcgaacttgagccgccgcagcacgctgcgcgcgatctcctcactgacaatcgcgtgccccttgaaatgatccacacccttttcatcagttgtcttcatggaaggttttcccatatcatggaacagcatggtcagacgaagaattttatccttcttaacatttttcagggcatggagggtgtgtcccgccacgtcatacttatggtggcgtgttctctgttccacgccgaccatagcatcccattccggcagaatgaccttcgtaatccccagctcatatgcatcctgaatcagatccggatgatctgacatgagcagtttcaccaattccacctgtatccgctctgcactgatatttttaagggtaggcgccagctcgcgcaccgcctgcgcggtattcttctcaatcgggaaagccagctgggcggaaaatctgaccgccctcagaatccgaagcgcatcttccgaaaacctctccatcgggtcgcccacgcaccggatcaagtggtggttcagatcccgcatccccccaaacacatcgacaaggcgcacctcgtcattataagccatcgcattaatcgtaaaatccctccgccgcagatcctcctccaggctggccgtaaaagtcacatctttcggatgcctgctgtcctcataaagtccgtcaacccggtatgttgtcacttcgaacccttccctgccaatcatcactgtcacagtaccatgttcaatccccgtatcaaccgtccttctaaaaagccgtttaatctcctccggcctggcagaagtcgtaatatcccagtcctccggtttgcggcagagaatagaatcacgaacacatccgcctaccgcaaaagcctcatagccatgcagctgcagattattgataatcataatcacttttctcggcaactctatcttcatctatatcttcctttcagatgggtaaaaggggtctgacccttttgcactccattttcagaattgttttataatttcttgttcacgcttttgacaagtaaatattatagcttgtctttgctgttcgctcaaccattttaaagtagattttaatcttttttcgtcataacatgcaaatgcgtcgtcaaaaatcacaggcagcggctcttcatagagcatgtccacggcagccatacgaagtgcgaagtatacctgttctatggttccacgcgataccctctccacagggatccgccgcccgccttcaaataaggtcagattcaggttttcatctgcaagaagttttttataccttccgccggttatttgttctaatatctgcgatgctttttgatttaaaatgttcccaaacccctgcgtcatattacgggatgcttcgatcatcttttcctcggcaagccgcagtgcagcgtcccagttctgcaggtttttaattcttttatcaggcatttccagctcggccagcagctcctgtaaattctggaatcttacctgcttctctttccattgtgctttgattctctgattttcccactccagtttctgcctattctcttcgatctggcgtttcttttcgtaatcgtattccgtattctcctgacgggagttcactctttgcccggcatttcgcctcctgctgctctgcaccctgtactttccatactttacagcaccggtacagagaagcagcagtcctgcacctaaaaaaacccatgacagaacggagatcgccccgcccccggcaaatacttctcccctgccggcaaacacgctccaaagccgtcccaataccccggcggctgttcctaatccccccactgctatcaagtttttatattggcctgcctcgtaattctctgcttcatctcccgtaaacggaatcgtttctagtgaatcagatagggggtgctctccgcgtagatgcgctacactcccggaatcttcagcgttttcatccagtaaacttttcaatatcttttgattttcttccagttctctttgcagtttcccggcatcctcagatacatactggcattcctgccgtattgtatccttttttgtttcccgcatttcccgaagtgacctgatttgctgttctgcggcttttctgcgctggcgaagagtttccagggcgcttcccaggtttacgttactgcttcctgtctcataataatttgccgcataatttttcaattcctctgccagaccctgtcctggttttgcactaagctgtcccatggccacagtattctcaaaagattccgccgtcattttacccaaaagcatgtccagatctccgtcatccacagatagttcttccccatcatcttcacagacaaggcgtgcactctttgtatatctgtcaaacttccgttccagaaagaagttttttcccgctatggaaaaccgcatagatccggcatagtaattggggttaacccatggctcgtatctgctgaacccatcattttgagctgcacgcccgcgtcctctctccatcccgaaaagcattgcctttataaatgcatagaccgtagatttgccatattcattttctccgtaaaaaacatggattccttcttctatgtaaaaatgcttatgtgaaaacttcccaaaattctccaaatacaactctctaattaccatactcttcaactctctccggatcaggacaaactattctccagaagtgcctgcacacctgcctgtagcgcctgatattccacactgccttcttcacatcctaaaaattcttctatatattttcccagcacattatccctgttttcctcataaagcgtctgataatcatatgcaggacaagtctcatcctcaatctctataatatttccgtaaaaatccatgtattgtgtttcaaactctacatccggatccctcaggccccggagaataaatttataaagattctgcgtacctcttttttccacagtctcccggatatagtctttcacactcccattcgtcatccgctcattcacacgcagcgccagatggatgtattcccttactgcacacggaacaaactccacatggactccctgttctgttatctcaccgcgcacaaaaccatgctgccccgtatcattcttatccactggttcaagagctcccgcgaataccgcaaagttctttatcagagcctgaggcttatggatatgccccagcgcgatataatcaaatccggaggcctccaggtcctcttttttgagtggaacatgcttctcgtcaccgccatgagccaggaggatctcatatcgcgcatgtcccccggccttcacattacagcgctcttcccggatctccctggcgtgataactgaacccgtacaccgccagatccaggtcaggcagcttcacatatcccatcctgtcccccagcagtggatacacattttcattccactggaaagtccggtaataagagccctttttcataaaatcgtgatttcctgcaatcagaactacctttgtatgtgataatgtggagaacagatagtttacttccttcagatcccgcagaagcggctgcctatggaacagatccccggctataagcagtacatctgtctgctcttcctcacatcgtgtaaccacctgcaaaaaagtatcccatagttcccgggcgcgtcccgcactgtaagcattccctgcatcgggctgcgctcccaggtgagtatcggcaatgtggataaatttcataggtacctccatataataatacactgttaaaaagtaacttgaggacgtaacaatgtccggtctgttacgtcctcaatccatctcccccgccgcaggcggctgggtaataaatatctaatattggcatcccggcaggctataggatctatggcccacagcccttgtggaaataaaatctacagttcgcagttatttacagttctcgggaacggtacaacatcgcggatattggacattccggtaagatacatgacacatctttcaaatccgaggccaaatcccgcatgtctggtggaaccatattttctcagatccagatagaacttgtaatcctcttcctcgagattcatctccttcattctctgaatcagtttgttataatcgtcttccctctggctgcctccgatgatctcgccgattcccggtaccagacagtccactgcagccaccgtttttccgtcctcattgagcttcatgtaaaatgccttgatctctttcggatagtccgttacaaagaccggacgcttgtacaccacttctgtcagataacgctcatgttctgtctgcaggtctgtgccccattttactttatattcaaacttatcattatttttctcgagaagttctaccgcctctgtatatgttactctcgcaaaatccgagtttacgacgtttttcagcctgtccagcagccccttgtctacaaaagaattgaagaagttcatctcctccggcgcattctccagcacataagaaatcacatatttcaacattgactcggccagatccatgttatcatccaggtctgcaaatgcaatctccggctcgatcatccagaactcagctgcatgtcgtgtagtattggagttctctgcccggaaagtaggtccgaaagtgtaaatgctcctgaacgcctgggcaaatgtctccccgttcagctgaccgcttacagtcaggtttgtctctttcccaaagaaatcctggctgtagtctaccgttccgtccggattcttcggcacattgtccatatccagagtagtcactctaaacatttcgcccgctccctcgcagtcacttcccgtaataagaggcgtatgcacatagacaaagcctctgtcctggaaaaactggtgaatagcatatgcaatcatagagcgcactctgaacaccgcctggaatgtatttgtccttggacgaagatgagaaatcgttctgagatattcgaaactatgacgtttcttctgcaacggatagtcaggtgctgaggttccctcaatctccacctcatctgcctgaatctcaaacggctgcttagcctgtggtgtagctactaaagttccagtaacaataatggctgcgcctacattctgctttgagatttcatcaaaattctccatactgtcatggtacacaatctgcagcggttcaaaataggaaccgtcattgaccacgataaagccaaacgtctttgaatcacgaatactgcgaatccatcccccaactgtcactttcttgtccagatattcctctttgtttttaaataattcccgaattgtaactaaatccataccaaatactccttattccatcaaatttttccttttattacacactggtactattataacactgaatccgcatgaaatacaatcccgttctgtcttctggcttcatccgtaacacgcagtgtatccagtgaatactttcgataaggatgcccgctgcagttttcctgcgcaagccttacaaattccctgacttcatataccatattgtttggagctggtgtatagggaatcgcttcccttttcccgtctctatacacgatttccatagactgcggcatcgcaatgccatatataagaatacttccctcttctccctggaatataccaggattcacagaatcggtaatctttgaataaacagcctcagccatcatgtcatcgtactgcataaggacaataccgctcccctcaaagccattttctaatttagttgagaacgcttttatttctttcggcattcccagcattctgaccagtgtgtgaatacagtataccccaatatccataatcgccgcgtttgacagctccgggttaaaggcattcagaacctctccctgcctgaacttatcataacgtgaagagtactggcagtattctgccgtcaccctgcgcagctttccaattttcggaagatgttccctgatcaggttataagccgggtcaaaatccgggcgcatcgcctccaggaggacgactccgttttcctctgcacaggcaaacattgacgctgcttctctctcattaacagccagaatcttttcgcacagtacgtgctttttgtgcttcatcgcctcaatggcctgcccgcaatgtgcatatgttggtgtagcaatgtacacagcgtcaatctccgattccagaaattcatcgtaatttgtatatacattgggtatgctgtgtctgtctgcaaatgcatcccctgtctcctgcttcctggagtataccgcacaaatctctgcctccggtacctgcccggctgcctcaatcagccagtcgctgataaaattgcttcctactattcctaatttcataatgccgcctcctaattatcctgcctttagcctttactgcttagtgatcctgctgcttcatgcataagcacaatctattcaattctttcttttacatgtattaccaatgaaattgtagcaaatatatgcggcattatcaatcactgttgtacaaaattgtgcaagcaggctttcgttctgggtatttcttgattttctccatgccatgtggtatactaagagccgttccaaagccctgtaaaaataaggtctaaagggctgtggctacaacaaaaagcctgccacaggcagcctttttgtacgctaaggcgcgagtgttcgagaccttccactcgtaaaacaaaacttatgaagctacctatttatataggtttatagttgtttattcccccgcaaaaactctggtttgtgcggggttgtttttttatcgctgtttatcattaaccatgcaattttgtactttttttgtactattctaaatgttaacaaaaaggcagacccgctggcctgccccgttaaaatgctactgctatcaattccatttctgtcgctttcgtgtccggcattacatggctgtacaaatccattgtcatagacaatgagctatgtcccatgatcgccttaagcgtctgcggcttcatgcctgactcaatggcccttgttgcaaatgtgtgccgaaatacgtgaggtgttatacgctcaaactcatttccgctttggttgatctgctttattatgcggtcaatttcatactgcacccgatcccggcttaacggcttcccctcttctgtgcaaaatacatacctccttatatttacgatcttctctccccagtagtacttttgtgcatccaatagtttttcaacatcccgggttaatggaatgtccctccgggaagacttggtttttggtgtatcctcataatatccttccccctcctcatattttaatgttctgcgaatatgaatcactctctttttcttgtcaatatcagaaaatttaagcccccgcagctcaccgttccgcaatccagttctaagtaacatggaatagaaattgaaaagatagctgtcttttgcatattccataaacatgtgttgttcttccttggtcattgctttcatgatatgctcttccttatcacttggtacttctgccaactttacaggattgcgctcaataagtccatttttaaaggcctgcttaaaacatccacttagaatagccgctactattttgatactggaaacagcgtactcctcttcaaccagatcattgtaaagagtttgtatgtgctcacctctgatatcggtaatatactttttgcctattttgcccttcaccatgtaactatattgtttcttatatgtcgaaatagttccttttttgagtttattcttcttataaacattcagccaggtttcaaaccattcatccagggtggttttgctactttctacaaacaggccgtgctgcagtttgtactttaagtcagtcattttcttttgtgtttccgtaattgtcgcaccatgtaccagatatctttctcccttgtacatgaaacgcccctcatagtcagtatacctttgctgtattccttttggtaatttcctgcctcttttatcgactgccatataaccaccgcctaactcattaggctttcaaatatcagggctattgcatagttaaaaccgctctcaaatcctgctttctgtccataactgctcccggcataaattaaatctgctacagattcctttgtcataccggcaggctcctcgatcctgtccacgatttcttcccggatcatttcagacaatccgccatccgctgatatggcagccgatgatttgctgtatgattctgtgtatatatttccaattcttgacatataaccgtctccttttctttttcccgccgcacggcagcaggtgaatcttgtcttgcaaatgggctatatgacggtatataatcaatatagcccgtactgtgtgtattgggttatgcttattttttgccccatcggtgttgccgcacctttggggtttttgcttttccggtcattcgcccacctcccattctcctatggactcgcacatgagctttgatccaatctggaagccaagtatgaatcccacccgttcggcctgatcagatatggataaggctatctcctgggctttagaataattttctgcacccatgctgttttttaaatcatcacgccgggccttgggaatgtcatagtcatatatcttacgcaattccttatagcgcggcatttgtacatagtaccggtacatttgttccaatatatcggctttcatagaattcaccttctttccctaatgtattggactctacgtactcccccttgtaaaaaattgctattctaatttacacccatccctcctatccactaatcttttaacaatttctatgtccgagttataccgccccatcatcttatatatgtcaacaacctgagcagcataatcaatgctgttgaaaacggcctcgcatcccctttcctgcatgagataatttgcatcaaagttttcaatcaattctatatagggagttcttttttcatagtctatttgaggggatattccgtataatggctgtctctgcatgtaacagactccctttaattccatgcacctcccatcttcgattttagtaaactgctcatcggttagcatttctaaaaatgtttgttcattaaggatttcagctttccacagctcatcaccgggtttaagttttatatattcaaccatagattaatcctcccactaacttatcaatcatattttaatttttggctgctgcttcccagggggccgatgtcaccgcaccgctcccccgaaaatctgtaatgtccaactaataagttatataattgcctgacgcgctctcgatccattccggctatgatcctgaataccatacctctacatctatcaatttgtttccttctatcaggagccattttaataaaatggtggcgtgcaatggtatatatctcttccagaacctcgttatcttcttccttatccattagataaagcatttgtactatgcattgcctatatccttcattttgcatactcagcaccttctttcatctcgatcagcaacaacatcgtttgcccctttggctttatatcgtcttttccgcctatattcttcgttactcatgtcggaatctccattcctcttggttttcgcatttcgcatcgtataaacaacaggtactgttccatcatttctttgactcccaaataacgacaataagtaactgctccccgatattgaaagtctgccacgagtgttaccaaatgcttataattatatcgcttatagctggcggcttctttgctcccattttccgctgcttcccatatttcaaatagcttttcgtagagctcttcaaacataatacggtggcggtacctatccttgcttaacataatcatctttttacaggtcaagacccgatacggaacttgtacatattccgaaatattcctaacttctaccggttcaagctcctcctctcccttaaatgttgcttctaacaaatcctgcgtcacatctgcaaactttgcaaaagtacagatatggtatggatgatattttataagttcttctaaattaaccaaatccaatttattcttgcccttccctccgggattatgctactatatatttgctttatagtgtagctccggctatgccgcccctgtcagtgttcgcaccactggcaagggctattttttatgcgatggagaatcttctgctctccgttgtcctcatgtactggtcatacagctttgcatgatccgctttgaaagctttaccatcaaatctgtttgagataaccgttgtgaaccttaccatataatccccggccttctgctcctccagatccttcctctgcatgtctgctttgatctccgctttcagtgcctcaatctgctcctcaatcttcttctgctgcgcttccagctctttcagctttcttacgcggttgacaatcattctctctgtcattttaaaatctcctttcctgtgcaatcccttgagcatcttcttgactattactgcgtctccagaccgttcacaagtatatggctcaaagtttgtgggggctttcggcttccccaattgcttttattaattgttgatattcggtttggcttccggctgactcatcttcctgactattgatcccgctgtcgttcactcacaggtatatggttttcagcttcacagcttttcgggctgttcgtttgccttacctttatcttatgatcttattatactagttgtgtacactacaatcaattgacatatagcacaaagttgtgtacgtaattttgtttatttttgtagtgtacacatcattgtttttgtgttatactttaatcgtaaggtggaatggatcttccattaaaaatcgccccatatagggagaaagtaggtgtaatatggctttgtccgaagaacgaaaagaatatttatatgactacaaaaagtcaaaattaaagcgcatccccttggatgtccaaaaagaaaaatatgaggaaatagctaccgctgcatccaaaacaggagaatccgtcaatggttacatcaaaaaggcaattgaccagcgaatggagcgtgatgctgaataaagctctaaatgggaaaaccagattcctttttagggcctcggaaatctctgaataaccactgccactccgtcaatactatttcatggaaggatgtgttaaaatgccattaccaaaccagaagaaagaatacactactgattttatttattctctgcctgatggggaacgcgctgaactgatagatggtcagatctattacatggccccgccaaacagaaggcatcaggaaattataggtgaaatatttgccaatattcataaccatatcaaatctaaaggcggtacatgcaagccctatatcgcgccatttgctgtattcctcaatcaggatgataagacctatgtcgagcctgatataagcgttatatgcgatccaaacaagctcaatgataaaggctgcgcaggcgcaccggactggattattgaaattgtctcaccgggcagcaggcgcatggactactacaccaaattatttaaataccgcactgccggggtacgggaatactggatagtcgatcctgagaagaaccgtattttggtttataattttgaatctgaggatacaggggactatacattctctgattccgttaaagctggcatctatgaagacctgacaattgacttcggacaactgaacatttagccactgccgcccccatccatcaggattgagggcggtattgtttccccttttagggtgtccgaaatgtccgaataacctttttagggtgtcacatttgtcactatactctttttaggatagccaaaatagccagaatctttttaaggactcagaaaatgaaggatgtttttaaagatggaataatggcagatacttgattccttttgccagatatgctatattaaagacacaaagagaacaaccgccacgagagtggtaacctctaaagttaagtaatcgccttacggcaaccgcctatcctgtgggtcagacagggtaggcatttttattttcgcttattgttcctatctatgtaggtaagcagcgcaatcaggaaaatcccgaatgtcaacatcaatgatattgcatctgatatatccatcagcaccacctcccctcttctgtgaagtccgggaggctaccaccctgtacacggttgttctactggcagtatagcataatcttctatattccatcaatatttaaattatcaatgtactctttatgtaattcttatcaaaaagccattttaatctttagccttatatttataccctaaaggcatttagattgattctatcctatttcgccacgactatagtcgttgttcaaaatattgtagcgcatccgatcagcccgattttccctctgctcctcattcaggttcattcctggatttattcttatccatgctgtcggcaccctggcacaaatgctgccatctttattctctgcaataatcctgcattcctccggccggctctctgccagtctcatcacccttgtaatggttctgccctgtgtaatactcactgtagcggtcttgctgtctctctgccattcaatgacattctcgttgttattatagtctggcagagcgatttcttttgtaccacactttacaacatcagccagcctctccagcgtgcttatctccagatacttattttcaaagatccagttaattgtgctcatcgaaagtcctgttttcctctcaatgtccagttcatccaaattcttactttccaatagttctttatatctattcacatttaatctcatgttttcctcctttatgcagacatagccataccatatcagctcttattatgtgataacgatgatcccttccacataccttgccaaaacctcacctaaaagtgatttatttccacatgaacgtaaccatgtccgaattacctctatcccgcttaacgataccgccctaacaccgctctctggtatttacctgcctgactcattacaccggttggcttgacctctggctcgtttcccggatatttcaagaagccaacatcccaatcatagaaatacaaatccagatcgtacagatcacaaacatacagatataggttccgctcttcaaagatactgttaatagtagcccgtgaatacttcttaccgaaaaatatagcctggttcctcatgttctccaatgcctgtagctttgtaattgtcatgtgccatttatcaaattgcttatattttggtttctcatactcaagataatggaacgggaacttaatcggaattcgttcacgccttgcaagcccgagcatcctgtaggaaatatagttatagctgccaatagatacattcttaattctgtcataaactggcagcggatagcattcccggcacagaagcccatctccatacagatacagctttgtacgcctgctgccacacttcgggcaaacgagaaacagcttttctccatatcctgtcttctgcttcgtgaactgtatgttgtactcttttccgtttatctttgctatggcagcaggcatactcctcgcacccagctttatgcaatcctttacatcaatatagcttctcattgccttctcctctgttttgtaaatatacgaaatactaagtatacaacattgcagcgttccttttaagggatctcgaatgtcttgattccatccctgatttactattgcaacaactttaatagtattagtgtttgttcttagattgggctggaaaaaatattttctggaaactgcactattggaaacagttacccacaccggttcctatagcatttaaactgttgctggaagggtggggggggggcttttctacgtcttcaataccacacccccatatatgcggcccgtacattatctgaatccccacaaccggtctactataggctttcctgcattttattttaggggggattcagcacaatgtagcctgctgccagatcccaacaaataaataccgttcgcattcgtcggtttccgaacgttcggaacgtcaccatattccaatggcatccctctcaacctcacttgtccatgtacgccggaaagattcaagccctatatgatgaattgatgcagccgcaatatattcttcatagtaccctctgaacttccggctcctgctgggctttcttaattcccgcatagctttgtcctgataactccgtgctacctcccgtgaaagattatacttctctcctatttcctgtagagttttgctatccaggaaccggcagcgtattacatccgattgaatccctggcaagctgtccaccgcttcccagagctgtttcttcatgccttggtagtccagccggccgattatatccccttccagctcctcacctgatccaacaaagtcctctacagtcagttcgccttcttcatctcctaaaggttcattcaggctgcgaatctgccccattcctatactttccttgatggactttaatttctcttggctgatccccaggagcgcacacaatacttgatccgaaggatcggtgccgtaatatttccggtattctgtctccatcttcttatatttgtgcatccattcccgggcatgtgtaggtatacgcactacattgccacaattctcaatatatcgttgcataccttgtctgatccagaacgcagcataagtgataaatgcaactcccttctccgggtcatagtgtcggacagcttcacacaaagcaatatatccctcctgcataagatcatctaattcagcatggcacgtaaacttcacagccatcattttcacgaaacgatggttctgctgccatagctgtagcatattgtcagcttcatccataccggcccggatcaacgcaacaatctgctcattagaacgaaaaaggggagcttccatcgtctccgcagatgtaccatttttttgttcatattcggaattttgtgtgaggatcggggggacatgcggtctgatgaattttatcggaacttttcagaccgcccctccctgccatttcagaaaattcctcatggttcgctcgagcttcatcatgaaatttctcgctgttcccccgcggttcaatctgtaattttgtgttgttcacctgtggttcaactggaaagttctcactgcttcctctttgcttattttgaaattccccgttgttcctccgttgttcgttttgaaaattgccggggttcacccggtgttcatttgacatatacggcccactcccttacaataaaataaaagtaaggtttggtaaggttttaacttgctctataggtattggagtgcctatagggcattctgcatattatcgctgatctcctgcaacacatgctccatacattcctgcgactcttctgtggggcagaatggatagatctgattaacaataggcaacataggaaaggcctgtaccagtaatgccagcctgtacgctttagatttacaatagctctgcatactttccagaatggtagattcatcacattccggatttccataacagaaacctatcaggtattcctttttggtcttattcgtttcgttttgtacaacgtaccaatatttattcattatcattatcctttcttctctacaatcaaaaagtatcaccatccagaagacggttactcactatacgtttctgtcgttcacgctctttttctcgggtagttttaatattttgtcgttcctgtctaaccatcaatttttgtgccaatgctgccagatattcatcttccgaatcgtttaacagttccataacttcatcatctcttgtatatactccattattaatctcaattctcatttttcttctcctatttgaaaccttctagttactgcggaggttccggcggagagttagcggagggagcgttacagccaaaaaggctttatttatataaggttgaagcattaaacggaaaagcggaggttttttcagttctttaaacagtttaaaaacctatatagtcattcaaaacactataaaaatatctttaaatgtcataaagaataatctccgcttctctgcttccattgattttagagggtttggccctccgctttggcctaaaaaacctccgctttccctccgcttttcctgaaaaacctccgcttttaccaaaatggaatctcctgctgtatacaatcgtcttctgtaatgcgttggaatccgtcatttttctgtttaagattacgatacaccattattccgcgcctaccatctacatttgcttttccaaccgggcagccgttcgcttccatcctgtcttttatgttctgcttatttacatttgtaaagttattgaactggcaccatgtaatgtatgcgctctcgaagtcaggcttagaaatcatatccgttttattccctgtgatgatatagcactctgacagatagcggtataccgtatctaacttttcgcgatactcttttactgcatcttcgcaggcctggcactttgtaaccttataattgttgctgatcagccggtgtagcccctccaagaaccagttgaatatcgcattacgttccataagcatcttgtctaatattgccccatccctgcgatcctgctctatcgtgtttaggcaaggcacaatacacatccgttcaaatatatgcccacctttatcatcttgaaaactgggtaaattattgcaggcaatcgtaatcccaccaggaaacgtataataataaggctgtttattctttggctctatttttaccggatcaccgcctgttaactgcttaaatacagcgctgtcctttatttcgctgccagtctggtcaccaatgctgatgacacgtttaccaactataccgcctaataaaaactttgacccttcattcatgtgctgtaaggggatgttcgcaatcttatcttctcccaatatatggcttgtcagattaagaagctgagtcttccccgaattccccaaaagagaccataagaccaaacacagcttagccctatatactttcacattcgaaagaatcagacctatatattcttgcagcacagcttttttctcctcgtcaataattccttcattgtcactacacaaatcattcatataccggtcaaatactggtctgtgcacatcctctgggtgatactcgcaatccaactgaatcgtactatacagttttggtgtatgcggcttcaatgctctgctccttatgttatacagcccgttcctcatattgatgtagtcctcgtttgtatccaggtcacggaaggtgcatatattttcttctttgcataatagcaggttatacacattgttaatcatattgtcactggcaagcccaatagggacatagcgacgaataatggacttcactttatttcggttgcacttgttgtatacaccatgttcatatacgaaaaaatcgtccttgtcctcttccggtctcctgacaatcagataatgaagtcccctgctgatgctatcggccaatatgtcaccgttaatttttagtttagaattctcccctttaccatcatgatacaaccagggtgccccaatattctctgcatcggataccagcttctgaaggttttctttcgaatgcccttcttggtggatataatcagttacatcccctttatcttcctgagaagtgagcgtccaccggatagaatgagcaaaatgctttaaatctctaataatttggtctttcagctttagtcccacttcgtcattatcaggaagaataaccactttcgctcctgtaaaataagaagcgtattcttttttccaatcattcgcaccgcctgctgtggtggctgtataacctagtttccttaaagtgtcagcatccttctcaccttctacaatatagaccggatagccgcctttcactgcccttaacagttctgacagacggtacaatgtagtacattctttctttttacagcacctatacgtatcattacccctgtctactgtcacaaaccggatgtcttttccttcaaagcgtactttcgaatataaataggtaccattcgcatctttgtaatcatatacggcttctatgtgttttccctggccatactcaaaccgttctttccactttggcggcttatatccgccaatatcctcaaatgacagcccaacctctgccaggatgtctttggtctcacatcccgcatgacaatggagcagcagcttcccatcaatttcagatatagtcaggctggcttggttatcgtaatgtaccggacatttacattggtaggaggtattgctaatctttctgcttatagcaaaatgtgtcaataattcctgtaatgtcataaatcggtgtcctccactaaattttccagtgcctgctgcccctccggctgctttaatgcccgaaatatgttgataatgagccagaaattttgttttgggacttattcgaaaaggactgagcaaacaatatagcattttataattttcctgctgcatattccaattttgtactttttttgtacttttcttgatttcagctttcccccatgctatactactattcgttcccagcctctaaaaataaggtctaaagggcgattcaaaccgagtgttcgagaccttccactcgtaaaacaaaactaaaggagaatttaataatgaaagatttacagagcaaaaaagtgctgttcacagcacaggcagcgatgatcgctgcgatctatgtggtgctgaccattgtgtttgcgccgttcagttatggtgaggtgcaggttcgtatttccgaagcactgacgattcttccagtgtttacccctgctgccatcccggggctgtttatcggatgcctgatcagcaacatctttggaggctgtattctgccggacattatttttggcagtcttgccactttgattggcgccgtctttacatggcagctgcgccgcaaaagcagatttcttgccccactgcctccgattcttgctaatgtactgatcgtaccgtttgtcctgcgctacggataccaagtaccgctcccaattccttttatgatgctgaccgtaggcatcggagaagtcatatcatgcggagtccttggaatgatcgtatataccgcactcaacaagtaccggcacacaattttcagaacagcgtaatataaagcgtgctatttttaaatctggaaaggaccatcttcggagatatattttccggaaaatggtcctttttctaattctaatattacatttttgtttacttcacatatcctataaatgtattgccgcttcccgccgtcattgcctccatatcatttacgctgactgtattctcctcgccgctgtcgggatcaatgtacgttacatccgtcgtactgtatccggtcagaagaatggcgtggctggaatctgtcatggcaattacagggaggcctttattaataacgtagagtacctggctcaaagtacagccggtcagattcaccctttttgcatgatactgcttcatctgatcctcacaagcatcaaaagaggactgatcatccgcccgcttaaatacctgtgcttctgtgtaatataccagatcccggttacccttttcccagatatatgactgatccgaagatatcactacgcccgatacctgttccgccttttgaattgcatacgccgccttgtcgtaaatttcaatcagctctcccatgccatatacataatatttatctgcttttactttcccgtcaaacgcaatcctcaccgcctcatccagcataacctgtttcggtctcagaatcttcggcgactggtcttcaattccatccgcatatgtgagcctcatctgcttttcttttaaatctgtggtataggattccagtgtgatattactctcttttcttacttcattattactgatataatcctgttttgttcccgtatatgtgtctcctgattttgtgacccgattcagcgtcaccaggttttcttcaataataatatccgaaatatacgtttcttccacagaataggtttttacaactttatttttactgtcccggatctccagctcatacataggaagcagatcctccccggcaaccgttctgcccttatctgacggcctctgatatccatatataaagtcgctggacacaaacccgagcggacggatcgtttctccgtcttttgcctccacaatattttctttcccgtttttcagattgagcactctgatctccgtagcttcttccaatgacccattcgtctgataagccagcatgtgtccgtcatcggacgccgtatactgaccctcagccagatcctccgcaaggacttcctgcttattgttatccagatcaacctggtacagctttccgcccgcgagtacatagagcatctgacgctcatggctgtagtacaccatcttgcccagctcgtcttctgcgatggcaaaagacttgttgcttggaataaacgccttttcctccaccgcatttttgtcgatgtcaaagtaatacacatcaacaccgacttccccctcgtgctcgcccctgttcatatatccataaactgcaaatgccgtactgccgttttcatccacactgatgatccgtacttcatgctgatcgtacctgctgcgaacgtcatgaccttctttgtttgcaaagctgaacaccagtgagagctcatctgcatcctgattgtatgtccaaagatccctttcctgtacaaaagaaacgattgtgccatttttgttcgtctcgtacggcacattagatgaagctataccaagcaggataccattttcgtttaaaacttttttattgccattaaatacctgattcatacttcggttgtaatccagcaggtataattcatctccactgtatctcacccgaaagaattccttgatattgtatgtttcgacctcttccccatcccccacacacgttacctgatacttcgccagaagagaggtatatacactgttgctctccttgatgctccattcaacatcactggaaatctcaggggccaggtttccccaggtcagctgcgaactgctggagtgaattgttaccgtctgaaaggttgtattatctccttcttcgttgggttcaaggtatgtgctaagatcggacgcattttttttgtcaaatgtcttagtatgaaagtcttctgcaaaattcaggcattctccgacagcaagatcatctggacgctcaattctcgtatagaaataaatgtcttgcttttccacctttagtgtgacctttagaacagcttccgatattccttccgccagagcgccgtttaaatccagctgtattgcagtgtcagaaagatccttaatctcaccctttttataaatctcttccccatccagtgagtatacctcataatggatttcctgtattacattgccatccgtatctactgccatctgaagcgttccgttttcttccagcggagttatcgtatcccgcatagcggtgatatccatttcattaacatagccggccagcgcatttacatttttcccctgtaccgaaaaagaaatccgcggcagagaaggctcgctcaggtcaaccgtcaaatcggccgttcctctgtttgtcagcagactgcttatgacaattgcgataagaaacacgcccgtcagaatgcctgcttttatccacctcttttttttcatttgtctgtcccctttattaaaaagattatcccaactcccattctcattccccatccggatacaacagtcttcccaggatcggatttacatgaagcaatgtctcacattctttgattttttgttctgcatcagtactgtttttaccggttttcaccgcacgcagcagtatattcttcggcgtatgctccatatcaataaattccaagacttgtgtggcatatccgaaagcctccagatactttgcccgcagcccgtcggtcaccagagcggcaaaccgttcctttaaaaggccatagtccatgaccggagccagatccctgttttctatctgcccatttaattcatgctgacaacaggggactgaaagaatcacctttgcattccagccaatggctttgctcagcgcataatctgtcgccatatcgcaggcatggagcgttaccaccatatcgacagattgtacgccttcatagtccgcaatatccccctccagaaattgcagtttgtcataaccgtacttttccgccagccgattgcaattctcaatcacatcccgctttaaatcaaggccgatgatgcgtatatcatactgctgtatttcgtgcaggtaatgatacatcgcaaacgtcagataagacttcccgcagccaaaatccagaatagtaagctcacgcccccggtcaagctgaggcagaatatcctcaataaactccagaaaacggttaatctgccgaaacttatcaaaccgggctttgacaacgctcccatcgccggtcatcacccccagatcctgaagaaacggaaccaccgtcccctcctgcagaatatacttcttacttcggttatgcgataattccggcgccttcacctccgcagcctgtctcttcctctgaatcgtaacttttcccttcttactcacaagaaccgtataattcattgacctcgtcgtcatctgcatctgccggaacgccgacatatactccacgatccgcctgcccgcatcctccgccgtcagattctcatggaacgcctgcgtctccgtgaaagattcaaattgaaaataaaggcttcccttcttttccaccggcctcaccttaatcttcagcaccccatccttcgtacgaggattactaagaatcccctgaataaaatctatatttaaaatatcaaccagtaattcctgtaaagattccataagcacctcttaaatcaaccatcattcgttcctacctaattgtaaagcaaaacaccggatggtgcaagaaacacttcctgattgggtacactttatattatcagtatcctcaaaaagccaaaacatattagaaaaaatgagaatattctgaaaaaggaacgcaaaggggtcagacccctttgcagcagggtctgacccctttgaacacttccccgatttacttcacccgaggaaactctatcgttactttaaacaaatcgccgtccagataaagtctgaaatctccttcctgcattgttgtcaagctcttagcaattgacaggcccagtccgctgccttccgtgcttcttgagatatcacctctgataaaacgttctgttagttcatccgcagagatattaagaggctgttcggaaatattcttcagagagaagcctacattctcctccgtcacccacagatccgcatatacacgtgttccgggcattgcgtacttggcggcattgttatagatattctccagtacacgccacatccgccttccatccacgtgaatcattgccggcccgtccggcaggttctgtatcatttccaggttctttgctgcgaatttttctgcaaactccccggcagtctgattgatcatctccaccaaattgacgtccatgaattccaggacaatattcccgctgctcactttggatgcttccacaacatcttccgttaatgttttcaggcgctgcgcctttgcctccagtatatcgagatagccctttatctttggatcattaaaattctcccgctttaacaaatctacatagttgatgatggatgtcagcggggtcttaatatcatgggacacatttgtgatcagatcggtcttcagacgttcactcttcatgccctcttccacagcccgctgcaagccgttgccgatattattcaccatctcggccatcttcaagtccccgccgttaaggcggtccagcgggatctgataatccacgttgcctgatgcaatctcccggattcctctttttatcctgctcttcgaaacagcccctcttactaccaaaaatacggcggccgcctctgtcagcagcatgaggataaaaaagccggaaaaacctctaaccccaattgccagccagtgtattaccataaagacacccaatgagaatactgcccggaatgttacattacggttcagccaaaactcttttaaaaacagacaaacactcctcagcaggctattcctccagacggtccctgccttaattctgcgcacaaggctcaggtaaccaaacaggaagcacgccgtagtgaatgccgcaagtattcccattaatattaaatcagataatctcaaataactgccataccctctgtatgccatattcgtaaataattcccacgaatagctgccatccggataaaccgatgtattagaaagtgatccgataccgccccacatgcttcctaaaaaggtgacaggtatcagccataacaggataacaaacgccgcacccagttccgtcttccacctgtcaaacagattcaggtggacttcaccgtccttgccgctccttcccgctatcagtgtcatccatatcaggattacaaggaataagatggagcagattgtacttccagccgccgccaatctcatatgaggcgcataggtatcataatcctgtgcatccgcataaaatacgtcctgtattggaaagtttgtatccacagccgccgcaaaaatgcagtctgccttttgtctgtaattgtaggacttcaccatagaacgccattcattggcagaaatatccatattcgtctcaaactctgccagtttcggccttacaatcaaatacttattgctgccgccggccttcatctgttccagattttcttttacagaatcgtaatcccggagatggctgttatttgtatatacttttttcgcactttcatctacaaacatgtaaatgaaattcgtgttcccttcttcccatgtatctcctgaataaaggtatctgtcaacctgggatgacagcgtactcagaatgttctgcagatagccgtatacccgggacagtttcccattgagctccggcgatttgtttaccacctctagaatattggcagcccctgccggcgtatacttttcccgcaatgcctcgctgaatgtccagcagtccgtatacaccgtgataccatcggtattcttaattgccatactattataataacccgatgtataatatccgttttccagctgattcataaaatcttcagatgtaattccttcgacttccagcctcagtttattatcctcaatcagagacttaaactctcccgtataataataatgataagttccgtcaggcttctcgcagacaaccacaccattgtcatcgtagctggccccttcctccgtgtactcgctgctccagttcacgaggtcctccagggtgtatgccagaccgctttcattctccccgtctattactccgttcttcgcaaaatttataatatcaaccagcttttcgggattatatttgccgtctgtctcaaaattattcttcatagcaatgccttccatgacatcccatgtggcactggatactaaattcttaaaactcgcggattcttcatatggcttgctcgcagacttcagaaaactatcgctccctctgcttccgaaaaaagccagcatgattaccatgccaagaacggctgtaactaccgtaaggtgggcaagcagcagcagaatccctttcgtcaccggctttttataccagtttttcatatcgctccttcctagagtttttctatcttatacccaacgccccagacgaccttcaggtatctgggctccttcgggttgatctcaatcttttcccgaatatgccggatatgcacggcaaccgtattgtccgctccgattgcatcttcattccagatcgattcataaatctggtctatagaaaaaactctcccctgatttttcattaataataataaaatgttatactcgataggtgtcagcttcacaacctctccgtccacggtaacttctttcagatcatcattaatagcaaggccgccaacctcatacacccgctcggacttttccttaacactgcctccgagctgggtatatctgcgcagttgagatttgaccctcgctaccagttccaatggattaaatggttttgttacataatcgtcggcgccgacgttcagtcccagaatcttatccgcgtcctcagatttagcggacaggataataatcgggatgctgttgttctctcgaattttaagggtggctctgattccgtccagtctgggcatcatgacatccagtacaagcagatgcacttcctgcgattcaagcatcttcaatgcctctgccccgtcataggctttcagtacatgatagccttcctgggataaatatatctcgattgcttctacgatttccttatcatcatcacaaactaaaatattatacatttttcatcacctcccttacagtatacatgatatctgtgattttttaagacccattggggaaaatcttataaatttcttaaattgttaagaatcttataaaatattaggatagcagcatggatcaggaagggcgatttcatgggattccctgtgttttgaactataaccaatataagattctaatgttctactagtattttattagtgctgttttttgaggttttactagtgtcgtttcactagtacaattctgcctattcatcacagccccatgttcgccctcaattgtcttccggaaggattcaacctcgccaatccgatattgcaggtgaggtctatgtttgcgctgcccattagtacgcctgacagcttcacaggccgtaggatcataatatccttcatggttcctatttgatcccattcaacagtgcctccaattcatcgattttcttctgctgttcgtccgtcttaattgcccccagaacggcattacaggccagtatgatagtatttgccaccttagtgtcaatctctccatttaaagccatgttagctactctggcaagcgtccgtttaatctctgttgttgttctcattctcagcctgacactcatactcatcacccccaaacatccggtcaaggtcttctattgtcttctgatcatatcgcttctcatggtcttcttccgatggactttcccaccacttcataaggatatcaaatgtggcttcacatttaggatactcttctttgaaatccgggctttccaataagttctttacagtcgtttgccccacctcagtattcagatcagggcattcgataccacggttataacagtaccctaccatatcaaaataagccggaaccgctttagagcttacctgtataaaccagtcttttttctcccggctcctcatatccttcattgctttcttatacatcctatctagcttgttcatataaccctttccttcaaaaataccccaagcgcaaggagaagacgcccggggtatctttatcaaattatttcagacctacgatgccgctttgttggcctgatagtagatagccttcttcttattgtccagtacaaacgcatcatagacaatacgaccttccaccagttctccgctgatccccggcgggtcactgtgcaatttataatcttcaagttttgtaggagctactgttgccaccggatgagcgatcataaacccgaagtcagacgctaccctgcacgctggcaccttaataaccgtaatgccgtcaatcatagcgataacgcccctcagacgcatttcctcgctgatatctgtcaccatcataatatcaggactcttcttcatcagaagatatacgtctggggtaaccagaaggactctccctgtttctggtacttctgcattgtcaagaaccgtattccctttcaggatctcgtcatagatattctctgccgtcagagtaaccgctacaggctttgttcctgctccggccgccatgactccgtaaacgtacttatcaacctccggaatgataacctcgcgctgctgtcttgcaagagcagacgcgccagtgagtacaccaccagtctcgtccctgtccatcttgtcgataataaatgtgaaagatctatccttctttagcgtaaactcttccagcgtatttcctacgctgccgagtgcgccgtatctcgaccaggtaacagtaccagcctcaccgtcagttgctcccacctcgctgccatcacgatcataatcggtcaggcctacagtgttcaccttatgtaccttcactgtgtgcgctcctgtccaggaaaagtcctggtttgtcaagagtgcttttttactctccgtgcaaaacatttcgtctacatgcggaatgaattgcgttactaaatttattgccatttctatttaccttagtgctgtaatttcggggcaaaagcgttctgtatggcctgctgttgtcttgcttctgctgaactcgttccaaccttcggcaccggacctgacagcctacgtttgaactcattccccaacgcttcactaaaaacgcctgtcacttctttgtagctcttttcaaactcctctttgctgctataatcaataagtgtagccagtgaagacggcagaccctctgcaatcaacgcatccattgcgtccgctttcaactcccttttaagcacttccctttctcttgtctcaatttcacttacctgctgctcttctgtgaacagcttttgcattctctgacgctcagacgcaatctttttcgctatgatccggtcaacgtccgcatctgtatattttctctcaggctcactctgttgcccttcctgattgccctgtgcaccttcctgatcttctgcagtggaagcccctgcaccttcaataccttctgtaccctgattcaataattcttcgcccatattggctcctttccgttttaagcccgccggctataattttcgcagtttataccgtgatgccgcacgccatgagatttttatacaatataccaaaaagaggacgcaggaacgactttattccatttctgaaaaaaagtcattcccacgccctcggcttacactggtaggagaaacaccagtgcggtacttcgatatattgttatatttattctatcacatatagggtaggtatgcaatcattttccctgattttccgctgtctgccaccagttttcagtaaccaattcagcagataaacagcattgtttgatgtcaatatacgcccttttgaacctcccttttgctggctgcggccttaccctcttgaccggatgtagccgccttaacacctctgaaagctccttatcgtccgtataggatactttgatctttacgctcatgctcttcctcctcatccagcagaagaagctctgctgtgtcctgatccactccgtagccgtccatgatgtcatataaccgctgttctcactcctctgtcatttcctcacctcccgtctgacaatcactatcatcgtattagaatccactggaactaccttttcaacatcagacttccagattgtcgatggaaccttgctgcaacctgatacactgcaaatataacttgctggcgtgtcctcgtatacctcaatttcaacgccttttcctgttactccaaataatgtactgaatttcatttgcttcctcctcttcatccgccgcccgctctgctgttggtagcagcattgcgggaaggcgttttaatttgttttatatttttttttcaaccttaacatttcttagcaatcttgccgccgggttcaggcattgcagtgccgttccccggaaggcagccacgctttatacgcccatttcgtccaggtcttccgctatacgttctaaataccttgataccccaaataaagcatactgcaaagatagcacatttaacgtatctgttgcattattgtctagctgattcgaaagtcctacaattatccgtgatactcctgtgatttccgctgatatatcgttcatatcttttttcatatttctattccttcctgcctgtccatgtggtattatgtagttgatttctttccgcatggctccggctatgctgccctgtagatattggcgtatctatggggctgtttttattgttacccttcataatactaataatttgatcgcaccacttggttcgatcattgttcctacatcgcgcccgatcagatcagcgatctcttgaacaacgctaaatgtatattctcggatgccatgcttttctatgtatcggtctatcattcgccgctcctgtctggtgaatccggcaaactgtatttctgataattgtaaattcattcttcacgctcctttcaatgcgcccctatagaaaaacggacttctttgacacgtacgcgtgaaacccttggttttactgggttcgtccgtactaatcaatctggtacatacgcgttactgtgatatgtacgtaccaacgtactgacgtactaaccattttgataagtacataaatatattgattttaaaggctttcatccgtacttatcaggtttagaagtctcgctatagcgcttggtctgtctgcaagtcaagttcctcctgttttggttccggctcgtcctcttcatgccccggaagaatccatatacttctgggcgggaactctttcgttttcctggttataatgcccagttcttccctggctcgttgcatcgatccatcagatatcttatttgctgttgccagtgtttttagttccttggccagcctacgtccttctggcatattattcacaatgaactgcttcgctgcttctactgccggagcatctttcacccttttcttgctcctgatcgcagtgtagtcatccattgacaggcagttctcgctaagataaacaattccgcccttgtccgggtctattttaaatagaatcgtcttccctttcttgtcaagacttgacttctcatgtgacataaatttcatgtcctcttcacccggtacattcccaagtgctatgtaacttctgcaagctcccataatatcggttgatccaagaactctcgttatagcatcgccttttccgtttttgttgaaatgacagataataaccactgcaacgtcatacttgtctgcgagttctacgatatgtcccatttgttcccgtgtcttatttggtgcgttcatgtccacttccccgccaatatatgactgaaacggatcgaatatcattaagcccggcttaacatccctcatgtattcctcgatttccgggctgtcaaaaagtaactggtttttgttatcattaaccgcgaaggtatttttcatatcggcaccgcatattctaagccgcttttttattgtatcgcctatcccgtcctccgaagtcaggtaaatcactttacccggtttgttactgaatgggacgatattaaaaaaacttctccctgttgaaacgcaggccgccatatagcacaaaaggtatgttttcccggttcccggatatgcagcgcacagcgtgactttcccgcgcgggacatacggctggtatagccatctgatctcttcctcttcaacgtcattgatacataccagcgatatcttttcccgctgtttcttaacctgtctgaacttccctttatcatagaccgccttatgtgttccttgttgtttttctacttcaagttctgcaataaggtcaatagctctctgtcgctcttctgttgtaagctgtccttcgtctgctgttccacttcttgttgtttccgtggttcatccaccttctttccgtcaaaatcctgtttcctgtaccatgctgccacattcttcatcatagcgtcatgcccgtgctgccactcagacatgatgcatgtgtaataattccttgctttactgcatccgatcacttccagccttgtcagaacatcctccgcaaagccaggcgttgtcatttcatagccatatacctttaggaagaaattcttttccagcttcatatctggccggatgcagtctaatagctctcttttggatgccattactctcccgctgcctttccgtcaatcctgtcatagtctataaccgtgtctggatcaatctccagtgcccggcagacgcgcccaaaccgctccagcttgaccatatagccccttcgcatccgatagactatattgatgcttacccccgccttatcggctatttcctgcggggtcaggcagctttttgccatcgcccctatgatgacctgtactttcgcacataccattctgcttttctcctttctgcctgatatcaggctaaaaccttccaatcattccaaagcccacacccgcaccgtgtgtcagttttcagtttcaatgatttcagttacgtctacgcccacacctttggcaacttttccaactgcctgcggtgtgatgttcttctggtttaaaatcatagcaaatcgctgtctgctgattcctgcccgttccgcagcctgtccaatagttaagcctgatctagcaagagcgatctcaaactttgcatcattgattctcatttcctcacctcatttcattttgtaatatttcactttgcaatattacaataatatcatttagtaatattgtcaagtatatattgaaaaaaatatttcattttgctattattagaaagaggtgattaaaatgagcgaaagagatatagccgttggatccagaataaaggggattaggcaaaacaaaaagattacgcaaaaagaattagcggaaaaactagggatatctcagacagcaatcgcattatgggaaagcggaaacagaagcgtatctctgaatgcaattgacgatattgctggatgtcttggcgtttctgctggttatttgctatttggagatttagatattaatgatgaaatatcacagaaaaaagtcgaagacgattcgaaagagtttacaaccattgcagcacatcttggcgcagacgaactaaccgaggctgaattagaagacgttaagaattatattgaatttgtaaagagcaaaagaaaagacccggattattggaagaaatttaaaaaaacattgccggaaaaagaacagaaagaaaaggaataggaaagctgaaaattcagccgtgaagccgaaatttcggcaccttatgccagtgcactaagccgtagtttttcctacgccttatgccagtgcacgaagccgctcatttttgagcatgttgcaggacaggcaagttttactcattttcgagtaataaaaggactttattccagaaatggaaaaaagaaagcgcaaaactcagccctctaagaggacagtccagttttggacttaccgcaggacaggggaagattccccaatccaataggcgtaccggaaggtacattggttctgctcatttttgagcatatcgtaggacagagcaaaattgcacagtctgatccgatatagcacgttgacaataatatacttacccagggaaccgaaggggcgatatttagccacctactcgaatgagaaaggggctgatgcttatgtacgttacatggagtgatctattcacttttgtaataatgctaatcgctataataacccttgtcagaaatgataagcacaaaaaatagcgccctcacccgcgaagtgtagcgctattttgtaatacatatttgccgaggtgactaggtttcagctagctttcggctcccttgttaagtatattatagtcaatattacggatcctgtcaatatatcttccaactatcccaaagcccacacccgcaccgtggaaggatggaaggagaatatagatggcactgataacatgcccggaatgcaccggaaacatatctgacaaagcgttattctgcccgcattgcggctttccattgcaggagcaaccaactcctactcgtaagaccaaacgcaccggaaagcgccgtccaaacggcacaggaaccattgtcctcataaagggcaagaaaaagaaccgataccaggtacgggtcaatacccggatcgatgatcggggctatccgatttatgatgttctggggaacttcccggatcagatatcggcagacatcgccctggccgaatacaacaaagacccttacgacccagcaaaccgccagaaaccttttcaagaagtgtttgaggactggtacaaatggaagttcaagaagcctgtagacgcaaagggcaagaaaaccagctcccaatattgcagtgtggcagcatttaagcactgcgaaaatctccacgactgcgtaatgtccaaattacaggccacagagctacaggagatccttgacagggaagacttatcacactccacgctggagcatataaaaaatctgttcaatcaaatgtacaagtatgcgctgcaattcgggatcgtggcaaagaacctctcagaatttgttcagataggcaaagaggatgataccgaacccggcgtaccatttaccgatgatgagcttgaccttctctggaagaataaagatcggccttttgtcgataccatcctcatatactgttactccggctggaggctcaatgaactggcccggatgccgctgaaagatatcgacctggttaatcggacattcaccgggggactgaaaaacaaatacagccgcaaccggactgtaccaatacattccaaaattatcgacatggtggcagccaggtatgaccctaagttcaaaagcctgatataccacaacggaatgaaagatatatctgaggcagactacagggaagaattcaatcaagcgctgttggattgcgggatcacggaacctcacaccccgcacgactgccggcatacctgtaatactctgctggataacgcggaagtgaaccgggtagcccggtacaaaattatggggcacgcggggaaggatatcaacgagaaggtatatgcccacaaggatatcaaccagctccgcaaagcaattgagaaaatttaattttagccatgaatgcagccttacccgctgtactcatggcttttctattagaattttattagtactgtttatcctcaggaacacccattttacgccattcctctccctgtagcttttaaaaatttcttaaattattattcatcttcttccgcttccggccgccccggcccttatctcaaagcctccctctccacctcactcgtccaggtcctgttaaaagcctcaagccccacatggtgataacaggatgccgccaggtactcttcataatatccccggtactttctgcatctgctgggctgtccaagcagatgcagggcgttattctgctgattggccgcggcatcctttgtgatgccgattgcctctcccgtttccctaagcgttttctggtccagaaatctgcagcgaatcactgcagcctgcttttcctcaaggcattccactgcctcccagagcattcttttcatattctgataatccagccgccgtacagcttcctcctccagatcctcttcggaggcgatggtctcctccatatccagaccgctgtcctcctgccccagaggttcactcagactgtatatcttctccatatccgcactttttctgaccgccttcagcttttcccggctgatctgaagcagagcgcataaagtatcatcctccggttctgagccataatatttacagtactctgctgccatcttcctgtatctgcggacccagtccctcgcgtgcgtgggaatacggacggtcccgcagcaattttctatgtagcgcttcattccctgtttaatccaaaaggcggcgtaactgataaatggcacctcctggtcaatgtcatagtgcctgaccgcttcacaaagagcaagatagccctcctgcatcagatcctctaattccgccctgcccggccccgcaaagcgccggcccatcattctgataaacggttcattctgctgccagagcaggagcatattatccgcctcatctacccctgcctgtattcgtgctgctaactgctcatttaacataatcccatccgcctcctgtcatatttgctcctcttacaccgcatttttgttaataccccggacaatcataaaatttgaaagtccgggatactctcacaaataatatcctatccacggctccacgtattttatagattcatttcgaatccataaaaatcatatcatattcgatttgaatcgtcaatatatttttattattcattttgaatctattcaaacaccacttaatatgttatagttttgaaatagatagaaaaaaggtgggataaaatgtctgttggagatcatattaaaaatgcaagaaagagcgccgggctgacccagaaagagcttgcggaaaaatgcggagcagccgagatcacaatacgccagtacgagtcgaacaaacgggagccgcgcaatgaacagcttatgaagatcgcccggatactgaatgtggaactttatgacttactaggttatactgcaccggaacaaaaagaacacgtgaaaaaagccagaatccaggttctgcaggataggttggaagaacgggaaaagaaaacagtttctttagaaacacaaatcacacggagccaggagaccgtgctccaatatatggagtcactcaatgggaacggacaggctgaagccatccgtctggtcgaactgctgactaagatacctgagtataaaaaagagagaagataggccgctgtcccagagcgtatctgaaaattcattatcgcaatatacctccccgcttcacggtctatggtccgtgaatagtaaccaattttgctcctgagacatataataaaatgataagtatagccactttttatatggcaaaggagtttttttatgagcacacgaggactagatgtcagtgaatttcaaggtactgtagactgggagcaggtaaaagctgccggatatcagtttgccatgctccgtgccggatacggtttcggcactttagatcagcagtttcagagaaacgccgcagaatgtaaccgaattggactccctatcggcgtatactggttctgctatgccatcagccctgaaacggcccgccaggaggctgacggctgtataaatgcaatctcttcctatcgtctggattatccgatatgctacgatatagaacaggcaacggtaaactacgccgctcagaacggagtgacacttaccccatcccttgcgacgcagattgtccggagcttttgtgacagagtggaagaacgcggctattatgccatgttttatagtaaccgtaactttctgaatacctatttcccggccgatctgtctgaccgctacgcattgtggtatgcctattataacagccagttcgacggcaccaactgcggaatatggcagtttacggaccagggcagtgttcccgggatcagcggcaatgtagacctagatacaggctttatcgattatcctgccgtcatccgcaaagccggcctgaatcatcttgacggaggaagcaatcctgcaccgccgcccgttcaggactacattacgtatgtggtacagcccggcgacacattaagcggcatagcagcacgctacggcactacctatcagacgctcgccgcactgaacggcattaccaatccaaacctgatttatgccggccagacgatccgtattccggaggacggcagctccaccgcacgctactacaccatacagccaggggatacactgagcggaatcgcacagaaattcggtactacggtcagcgaactgcaaaggctcaacggcataagcaacccaaatctgatctacgccgggaatacgattagaatctcataagaatgtttttagaatttggtaataatttttccacttcttttatagaaacgacatactttatgcacatttatctcttataataatactcagatagttgataaacaactatctcccccctcataaagtaaaggtattctgaaatgcacagaatgccaactttactctcattcctttagataactataaaaacaacgaaacccctgtagccgatactgcaggggttttcgctgtctattgtgctttttacgcgtgtcttttctcacgccttgcagatcctgcaggacaggttttcgccgtatattgtgctttttctgccggctccctgcccattgtttatacttttaaatctgcacattccaaaaagaactcccttaagatagaaaagacatatcagcctccaaaacttctaactactgccccgctgattacatccccgatcagttcataacctttatccgagcaatgaaccatatcttctcccggaaccgctccataaacgcaccatgttctcctgttaatccccgatgttttccacaggttacataccggaatactgttatctgcggctactgcttccataatctccgtcatttttttcagggatcttcctgacccaggcggatactcctcatacccatccgcattaatatatgaatatttccctacacagtgcggtgtgacaatcagaattctgcaatccaaattgccggcctcctccaggcggtcgtaaatgatatcaatgcaatattgcagtgccgctgctgcgtcagtatccaccctgtcattatatcccgcaaaaaaaataaccagatccatttccgccagaactgaggcagacaacggggggagtacgccctccgcaccgactccgccgtccacaatctcccgcattttaaggccgcctttgcagtgtctgtacaccctgcagcccagattttgccttaaccgctccgtccatacgcctgcctgcgtcaggctgtctcccatgcagcatacccttttattcttccatttttctgtcatcagcatattttgtacctcctgcacgcttttctatctttcagaaattccaattagatcaatcattcatcatcggtcccgtttgttactctagtctgatctcaaccatctgatgcccttctatcttttcgacttcaaattctacatatccatccttttcttcataagcaatcggtttattctccgggacaagccgcattcccttcatatggcgcccacccaaatgtactctgaactccgtatggtataaaggaatcacatcttcaatcgtataaatttcctccgaccttttttccggaatatagtggagcagatgcagtattttacaactctcttctgtttgatccggcctatcctgtgtctgttgactcaatatacacagcaggctggacggaccgttatgggaaaccattttatttccacagaatctctgtatcgcatcactcaccataactttacaccatttcggcgcatttttcctataaatcccaaacacaggatgtgcacaataaatcacatttcccttctgaaacagttccccttttctctcataatccggggtaggtgcgtgttgatggctgcaaaagcgaagcccctcatggccggtcaaaccctcactggacgcatttccagttccccctgaccatgtgcccctgctgccccgttcaaaccacggacgaattttctccatgattacattcgcagaatcagcctccgcatccattcctctctcatacattacaaagggctctttcggaagctccttcccaatcgtctcgttcggcagtacaaattcccggctgtactctgatttgttaatatcacggatcccatacagctcactttcgtcccccttgatacacgcgttaaaagaggcaaaaaccgctccccccttctccacatacgcgttaagtttcctctccagttcctctgaataggggagctcatccggcaaaagaagcagcggatacgcttcaaagcattcctcaggatcaatcagcgtgaattgatacgccatctcctgcagcatatgcactgcgccgatcagtgatttgggcagctctctcccatccagaatcggattcaaaaacacatgcggtgtaagcaccgctatctccgcctccgggtatgcaccgcggcagtactgctccttctgttccacactttcatagacgctgccgatcaaatcataggtcgcttccgacaattgcccccacggatgaagctggtctcccacggagcagcccgctcccatggcaagcatatggaaacattcgaattccagcgccgctttatttttcagcgaatggaaatccccccacgaagtgtggaacttccctgtcatcccgatcatttcttttccaaaatgcccagcataccttgccataattgggaaatggtcatatccccagtccccgctcggcagtgattccagttccaggtggctgtaggtgtcaacggagcgcttcatgaccagatccacgcccggatcattatagaagatcgtggcattcggcgcactttcccgaatcaaagccgatatctcgctccggaaacgattcagcgttagctctgcaaaataaacccggtctgtccgaagcttgggattcagcccttcctccagcattaaccgccggcagtccttacagcagcattctgtctgggacatgatatccataaatattccatccagattctctcttccaaccacctcaatgatatccctcagatgctctttaaaaaactcccggtagccactattcaaacatatgtcatagtaaaaatgcggttctggcacatttcctttatccaccggactaccatgctcatcgcggcacagccactctggtttctcacggataatccgctcgtcccatcttacggtcgtatagactggcacgcggatcccacgtttatggcatgcttcgatctgttcctgcaaaagattcctgtttacgagattcggatgtatcagctccggatgattcacggacggataatacagccacccatgatggcacctggcaaaacacgttacagaatccacgtgcgctctttccagcctttctgcaaacctctccgcatcaaaatcttttccaatctctgttatatactgacttgtatgaaaatccatatgtacctgtctgtatcttaatttttccattttacatctccttctgctctgtatgtttttagccgcctttctagtctgtttcctttattttgcagcttgctgcaaatccgcccttccggggcatggtttttggtgttttctttggcatacctactccttcaccgcccctgcggcaagcccgccctctaccttttcctggaacagcatataaatgaacatcggcagggctaccgtaatgacgattgccgccatcatcagcccatattcggtgcctctctccccattgaaattaagaatcccaagagccaccggcttcaaatcattatccttaataaaaatcagcggaaaaataacattattccacgcgttcagaaaattaaagatagataccgtagcaatcgccggctttgtcatcggcagcatcaccttccagtagatctggacataatttgccccatccaccagcgccgcctcttccagggaacggttcaccccccgcataaaattggtcaggaccaaaatactaaatggcagcccaaaggcaacatataccaagatcagtgccggtatattatcggaaagattcagcttcccaatcatataggatatcggtaccagcaccgtatgcatcggaaccatcatcccgatcaggaaaaaaagcatgacccctttactgatgcgaagccggaatctggataatacaaatgcagccatagaggacaggatccccaaaacaatcaccgtgattcccgactgtatgatactgttcaaaaaataccggctcatccgggctccctgccacgcatctatataatttgaccacattggcgttttgggaagtgcaaatggagcggcgaagatctccacctttgtcttcagtgaagacatcagcgtaaaaagcatcggcgctgcgaacatcactgccatgaccgacagaaaaatatatactccaacccgttttttcttcatcgttctccctttctcctaatcgtttttcttcatctttgcctgaatcagattcgttgccagggttcctgcaagacagatcaaaaggatcacaatcccgatggcgctgccctgaccataatgtttatatttgaaagcttcattgtacaaaagcgtagtgggcagattagtcagcccgttcggccctccgcctgtcatcgcatacaccaaatcaaagacctttaccgatcccatgatatcaattaagatgcagacaaaaatcacatccttcagcatcggtaccgtaatgcaaaaaaactttttgactggaccggcgccatcaattgcagccgcttcatacacatcctccgggatcgacgtcagtccggccagtaaaatcaccatataatagccaataccagcccagatattcacaaagatgatcgaattcatagccgtgctttcattgaccagccatggagccatcatatccgaaagtccgatcacatctaaaaacgcgttgattgcacccgtaggcatgaatatgaaataccacatcaggccgacagccgataacggaaataccgtaggcacaaaatacatggctttaaatatgcgaaaccctctgcacctcgtgttcagagccactgccaggagcagagcagccggagtgtggaacacgacactgaaaacaaccatcttaaacatgttcttcagcgcaagcaaaaaatccgggcttttaaatatagttttaaaattttccaatccggcaaactcgattgcagaaccggcaatcccgttccagttcgttaccgaaaaataccccgcctgcaccaacggaataatctggaacgcggtatatatcaacactgccggaagcagaaaaactaaaaccgtcagtatatccttcttatttttaattttgagcattttcctctccttcctcatccagtgggcgcccgcgcaccctgccttagggtatgcccagaggtataaaacgagccaccctccgggaacgcgggcccaagccgcatctcccggacagatggctttcatttattgtgccgcatccacttctgcctgaatttcttttgccgcatcttccgccgatgcattgataaacatactcacaatagaattccttgtccggtccatcatagaagggatcgggtcaaaatcaaacacatctactccgataccggtattattctcacagagtttgatattgtccgccagaagccttggaacctttgactcatccagatcgatgtcatttctcgggatcagaacgcctgcctcctcggaaaatctcttggccgcatctttatcagtcagcatctggatcagctccattgtcagatccagctcttttccttcaagctgaccgctgaccatataggaaccaattgtctgcatattttcatttttaaactctggcttttcctcaaaatacgggaaatttgcagtctcaatctgatcagaaaccggggtcagcgtctcatccaaaaagctgtcactgttccaaagcccggtcagaaccatggctgcctgtccctcccggaactgggtgagcgccatctcatcggtaagaccagccgcattggggtcaaacgcacctgcatcgatcagatctttcacaaactgcagagtctctaccaccccctgatccgtccagttcatttctctgcttccaagctcttttgcagcatccgttcccagccatttgtaaaaaatggaatcatgcagatgaccagccatataagtggactgcgcgcccattgcaatcggaattacgcccgtctctttgagttttgcaacagcgtccagcagctcgttccaggtctctggaaatttatcgatcccggccttgctcagaagctccttattatagtaaaaactaatcgtaccggattccattggaattgcatataccccatcgtgacccggaactttaaagtaattcagcgcgccctctgtgaaacctccgccccattcctggtctttttccagataatctgatacgtccttaatcaggccgttatcaatataatccgccagattggcaacaccctgaatccggaagatatttgccatatcgccggaggcaatatcagaagcaatcaaattattaaacgcactttcctcactttgagagttatccacaatctcaacctctggatgtgcttccttgaattcgtccagtatctcattgtagatctgcgtctgtttggaggttcctgcaattcttgttaagatacggattgtcaccttatcctccgtttctttccccttatccgcagcttccttactaccgcttgtgcatcctgctaacattgtcgccccaagcgctgccgccagcagcatggatatgactttcttctttacatgtctttgtcttgccatcataattctccttttctctcctatgttttgtcataactattaacccgccgggatgtaccccggctgctttatgctgttattctaaccgcaaaccaggcatattaaaatggacaaaatctaggcggcatgtacatttccacgataaaaaaataaacctcgtccgatattcttgacatatgaaaaagatacatattatagtaattttaccactacagaaagcaggggtatatatgaagattcaaaaacgggaggcccccctcaaaaccaaattttttctctctatgtgcagcctgaccacctccgtgaccgtcctgctccttattatcatgtcccttattttttacggccattttttctctgtacaggcggaatcctccgccctgcagctgaacgcagtgaacaagcagctgaatttttatctggattctctggacaattattccagaatgatgatcagtgataccatcatacaaaaaaatgtcatcaagtatgaaaattccaggcggaaatacgcgaaggctgcaaaggggtcagacccctttgaactatacacggaggcggaccggaccctcctgcgctccgagatgcggaagtttcttcagacaattccctatattcactccgcaaccatttatgcggatgattatacttgtattgcttcaaccgcaaccgctttatatcccgcgcctctcaaggccatcggcacggagaggcagagcgtttatgccattacccagaagttttccaatttcaacctgaagaccgagatacagactttgtctctgctgcgccctttttatgagattgcaaccggaaaaagacttggctatattgagatctccatttccgaacaggatatcgcggcgctatactcggccaatacctcagaaaccagtaaacttctgatcacagaccggtcggggaaaattgtaagtacagacggcacctatgcgttaaataaaacctttgctcccatcacgaatcaggggggcagcattccaaagcagttttacacgggaaatgggtctatctgttttgtctcatacatccatgatttggactggtttattgtaaatgaagtgaaactctccgcctttttccagccgctgtaccgcattcttatgataacagtactgatttatctgctgttcctggtattttccatggtgatatccagaaaggtcagcgaaacgattacaaaaccgctgtatctcctgatagcacatatccaaaaggtaaagcagggaaactggagtccgctgaacaatgctcccaaagacgtggattttcatcttttattccaggaatttgacagtatgcttttgtctcaggaacagctcacccaggatctgattgtagcccagaagaccaaagacaaattatccctggatcttctgcagcagcaggtgaatccacatttcctttataacacactagacaatattgagtcactggccgaactggatgaaacggcgcttcttatccggcttgtctcaaacctgtccgaattctatcggcacagcttaagcggcggtaatctaatcgtctccatcgcagatgagctggaactgacacaggcatatgtcaatatcatgcagatccgctatgtggacaaattctcctttactgtggactgtcccggggagatccgggctcgccgctgcctgaagctgcttttgcagccagtcattgaaaacagcatttatcacggcataaaagagttggacggctttggccatatcacagtgcaggtgctgatgtatcattccgacattaaattcgtgattgaagataatggcccgggcatacttgaagaagctttcaatcttcaaaatatttccggggaagggcattttggtatccaaagcatacaaaaacggattcagatgtattatggtgataactatggacttaccatgcagaacagggaacagggtggtcttagaactattatcataataccgggagaggatagggcagaacatgagctataagattattgttgcagacgacgaattttatattcgcaaaaaactactaaagattattgattacgtcgggctccaactggaactggctggtgattttgaaaatggccagggcgttttggattatctgtccgggcatcacgccgacatcgtccttctggacatccgtatgccaaaggtttccggcctggatgtagcacggtttatacacgaaaatcacccggaaattaaggtcatcatcctctccgggttcagcgattttgaatatgcccagacgacgcttcgctatcaggtatttgattatcttttaaaacccgtagaagcggatactttaaacaccactctcgaaaactgcatccacagaatagaggaacgcaggcaggagcaaaaccgcctggacagcctttcccactatgaaaaaaacatacggctcaacgcggttctgcgtggaaaagatacgttccattccatgcaggccctgtaccgtgaatttgaaaagatccgttactctgcattctacgccttttatgtggacacagacagtgcccccgctgcgggagaactgatttctgccctgcgtgacgaggaaatagagtgcgaatattttattgagagcgaccacattttttatatccagctttttctggaagatgatgtgccagaacctctctgccggtatcattgcaaaaagtttttccgtgcacttgctcaacctcatttttattattttggagaactttttaaggcagacacagactggctgccttacaggaaacaggcactaaatcggctggacgatcgttttttctctgctgcaggtgaactttcttcttctgctgtgaaccaggtttttgatgagacggcctccccctcagacggcactgtcggcatcgattccatccggcagtccctgacacgctttctcaacgccggggacacggccggattcctgaattatatggaaaccttatttggctcgattgtaatgacaaaatcctctgattacctccatctggctgtaatggaaatatgcagtgttttctcgattttgtcctcttcccggaaaaactgccgccctctcccgcgggattatgcacagtctatcatagcggaggaataccaattagaagaaattctggctaccttaagcggctatggaatgaattatatgcaaagcgccgacgcggttccgtcggacattcgtctcagccagggtatcatcaattatctgttggagcactaccaggaaccgtcattaagcgtcgcaaatctggcagagcattttaacctgacggtttcttatatgggcagcgtatttaaaaaggtaaatcatacttctatcctgcagtttctcacgaccttgcgcataacagaggcgaagaacctgctgaaaaccaggcagtataaggttgccgaggttgcagaaatggtcggctatacggatgtcttctactttagtaagcggtttaaagcattgtgcgggcattcaccgaaagaatttatgcacctttcgcattaggagagccataataaaatcaagctgcctcctgctcaaacaacagcagatcaaaacccccgcagccaatcctgcgggggttttcattgatatacattccgaattctctcaatacctgaactatccgaaataatttactttctgttaatacatattacctttttttacgtctcctcatcaggaatactgccgctgcacccagaagcatactgccgcccagcacgccgagccagattccaaccattgccgtatcaccggtcttcgcagattttaccttcccggttccctggctagctgttgcgccgtttccggatgttccggtatttccgctgcttccgttattttcattgctgccagaatttccgttatttccattattaccggagtttccattattcccctctttttccttcaggtcagccttagcctgtttcaactccttaaccgcattatccacagttttctgatcatctacagacaacgaatcatcctccattactccatttgcctttgccaaagctgtcatatagacttccacggatgcctcagtatagatattcaaatccagatctttcaggctttccaacagttcctgcaatacagctttatttgccttcagtctgagattgtccatcgcttcgaccagagcactccaggcagcatctacatcttcctgcattgcatcgccattggccatgactgcctctgccccggacttagcagcaagatattctgcctgaccggcctcaacatatttgttcagatcaattaactgagtcagttccagagccatctccagatcggttttgtctccggccaagaaatccaatgcattgattgccttcatcagttgtactgttgcctttgtaacatcctctttcgtagccgcatcattctccatgacagcatcgccttcttcaattgcttccctgaataaattctgaatggtttcgatcagatctgccgtatctccattagccacatgttcttttgctttattcaggaaatattccagcgtcttcttgctaaccggctccgtaaccgctgtctcttcccactgtgcatatacagtttgagctgcggtaaagtctgtcaccttctcgccgccggtctcggccgtaaaccagcccttaaaagtatatccgtcttttaccggatcagccggcatctgaatctgctctcctgcgtttgtaacaaccgttgtctcaactccgtctactataaatgtggttgtaaatgtttctgtttctgccggtctttcaacctcgccaagcaccttgaagaaatcaactgcaagcttgctgccgtttttcttcacgcccttgattgtatgaattccttcgttaagtccggatacttcatagactttttgctggaattgtgcattgccggactgcaggttaattgtatcgcacaattcaccgtcaatatagatatccacttcgcccatttctgctgtttttgctgtatagaactccacgcctgtgccgcagaattcgaactcaaaataggatccgtcattggtggtataggtataatcagagtgatagtaatttccgtcattatttacataagtccaatcagcagtatcgttatcattctggtcgtaatatttggtaaaataccaatgatcattgtatgtttccattggtttcagatggtcgccgccctttactaccgctttaatgcgcttccactgttccatctggtcaggatcaatgcgtccgaatctgttcactcttgaatcagatacaagaacagcatttttctctacattattcttaaaccatcctgtcacctgctcggtatctaccgctgcgcctttttgtccccaatatccatagaaaggtacgggaacacccatgctggacatgaagaaccactggatgccaagctcctggctcgcccagccgtccatttgtgagagtgccggattccgcgggcagacagagttaaagttggttggaggatgcgcttcaccgcctacataatcttcataaggtacgttaatctcatcgcttccgccaaggctcagggaaaggatacgatttgaatttccctttttcagtgcgtcaacccatgtgtgccagttgtactccttcgtgggagcataagctgcattcgggttcgcatttgcattcggagtcaaatccggattcacttcataagtatttccacgcatagagttttctgaagtccacattccgtcgatccaccatccggccagatattccccatagtgttcagaccagtatcccaggacttcctgccattttttgagtgtttcctgggtaggcggtgtgtccgtatttcttgtctggccaaatgcatctgtaattccatagtccccgtcatgcggattggttgcagcatcaaagttcggtccaaagtttctgtgtgcccggaacggagggcagcctaccgcataaaacatcatcttaatcccatgaggttccagtgcctttgcaatctccatcggcaggtctctggccgtgctggacggcgttctctcaccctcttccacctgcgcatacttgtcataaaccggattatgcgcattgaaaaatccatcgtgctgtccgattgtaaagatcacaaaggaagctccggtttccagaatatcttctacataagcatctacatcaaagctgtcgaggtaagcatcccaattctcttcaggttttaatttttcatcttcatttgctgccgccagagtgatataatcgtgcaggaaatgatgcatgattccgtattttccgtctctgaaccattttacttcctgattgcctttattctcaataggccctacaggctctgacatgacaggctcaccttccgcatacttttcattgaccggcgtaaccattgcctttagatatctgtccgtataatagctgattaagtagatatcctttgtccggattccttccagctttgtatattccccgtccttgtctcctgcaggggaaatccaccattctatttttgaacggctttccacttctccgtcggtatcctcataatcataattcactgtcagacctgcttttacatccggagttccttcaactgtaacatttgagactgacggcgggttagggtcatcgtatttggctaccacatactgcccgtccctggtcactcgattgtaggtcaccgccatgtcaatcgtctgatcagagcccacggctgtgaccggatcaaactccagagtaacctgaagcccgtccaccgtacagttgattaattccaccggtttcgtctgagtagggtctaccaccgagttgtgcatggttacagcaaaatcttctatgaccggctcttctgtaaaatccttctcaaagtcaagaactagttttccattctccgcagtcagggtaaatggattcatattgtactcgtactgtgccttaatctcttccgagctcagagtagaattatatattttcaattcatccatggctcccttaaagggccttctctgtgaagccaccttatctccgatcagcagagacttgccctctgtctgaagattaccggtacgaccattcacggtatcctgccctacttcttccccattaatatagaactttaagacatctccgtctgccgtcaccgcaacatgctgccattctccgccctgcagggatccgtacatattctcgcgacctgcgccgtcattggttccatgctgaaaatacagcttactgttatgttcgcctagaatccaggaattccgatatgaattttctgtctggcggctcagaatcgtcatagaagtgcctgtccccacagaatctggataaatccatgccgaaaatgtataattgggctgtacattaaaatcaaacgccgccgaggactcggggacatagatctgcgtactgccgtcaaactgcagcgcattcccgatctcccccttcacaaactgtgccgttccttcaatatcaaaaggcgtctggctggcactgtccaacgcggcatttccggattcctcgtcaaaccccagctgcagtatcggctgcaccaggtcttcggcccgcacttcccgggtcagccccggcagaccaaacgaagttcccgttacggcaacagccagcagtaaacccgttgccttcttagaaaactgttttaaactctttttcaccttactcttcctctctttctcatcttcttttatcctgtcattctcgtgattttcaaagttctattaccttccctcctttcatcctggattcctccgcagcatatgccatcacatgtccctgaagggaaagtcgggcactatacatcaggtttttctcttccgggtttcgcaatgcttttgtgaatgtttccataatgcactcatccccgcccgaatgcagtgtttttggtgtatgtacttctactgtcgtttcatttcctgaaccaaaatccctgataataaaccggtcctcatcgatgcttccttcgatctctcctgccgtgcccatgatcttagtctggcgcgccgtatccatggtaaatgcaatcgcctgccatgaagccgtaaccccgtcctcgtattccatcatcacaacctgatggtctgccacgttattatcgcagtagtaaacacaacgtgcatacggtgtggtcagcatatatttcaaaaactcatcattgttatccgtacgtttgatgatatccctgaaattatggcggagtttccggtcttccagatatttgtatgcggaatacatgcagctcttattatagatgcagtcctcacagcgttttgcagccccttttggagcgttctccggcctaaaccaggataaagatccaaaggaagagatcttggtgcactttttcccgtctagaagatagttcataatatccgtatcatggctgcattttgcgacgatcataggcgtcgtctcatcgctgttgcgccagttcccgcgcacatagctgtgggcataatgccagaatccaatattttcgatatgatggatggactggattttcccaatcttcccctccttaatcacctcttttacagcccgaaagaacggcgtatgccgcagaacatggcataccatcagcaaaacgcctttctccccggctgcatccacaatctcttttgtcttttccgccgtttctgccatcggtttctccagcagcagatttaatcccttttcaatggctgccatggcagggtcatagtgctgcctgtcctgtgttgcaataatcactccgtccagttcccggctatgttccagcatctcatgccagtcggaatatcttcctgcttccccaattccatgcgcatccgcaaacacatctctgcgctcctttaatggttccgcaacacagacgaattttacttccgccggatatttcaaggcatagggagcatagcagtttgcccccctttcccctgctcctatcagtcctaatttcaactgtttcatgttgtttctcccttcttcgcaaaggggtctgacccctttgtttgcactatcctttgacagccccagccgtcatacccgcaataatgtatctctgccccaatgcatacacgacaatgctcggaacgattatcatcaccatgatgacacataccaggttccagcttctctgatacagtccaaagaagctgtataccatcgtagtcagcggcattttcctggattcattgattacataaaacggggtcacaaaatcattccatgaactcataaaatttaaaataatcaccgttaccgtaaccggcttcaacagcggaaatatcacctttccaaacaaggtcagcgggccgcacccgtcaatgatcgcagcttcgtcaatttctcttggaatcgatccgataaatccgtaatataaaaacacagtaaacggcgttaccagcgctgaatacagcagcaccagccccaccagggaattggtcaggtggattttctgcagcaccagcacggccggaaccatattcagcggcgccacaaggcctaccagaaagaacagatatattttgttatgtaacttcgtttttcttcttgccattacataggaggccagcgcagcccctgtcgtcgcaatcaataccgtaaacaccgatatcagcatgctgttggaaaacgcctgaaagatatctactgtttccataacctcctgataattccccagcacccactgggtcggcatggaaaattccattgcaacggattccccctgcgttttcagagagttcagcaggataatgagaagaggaataaataccaggattgagagcagccataatatcaatgctttgataaaagacagtattttcttttttctgaccatcttactcctcctcccttgtcatagcctttaatactgagaacgccacaatacaggtaaatacaaacataataagccccagtgcggtggagaatccataccggcccgaactgtattctttgtataccagcgtattcagcacttccgttgccctcgccgggcctccgtttgtaagcacaaatacaagatcgaacaccttcaggcccgcgatcaggttcagcaccaaattgatggtaatcgatggaatcatttccggaataattacataacgcagtttctgccatctgctggccccatcgatgtctgccgcctccagataatcctctgaaatcgcctgcagccctgcaatatagatcaccatattctgccccaccaggcgccatacttccacggccattaccgcaattaatgccgttgccgtgctccccagccagtctttcgcaagcgcgtccagcccaattgcgcggagcgcttcattaatgaccccatactgggaattgtaaatagacttgaataccagcccgataattaacgggcagagcatgactggaaaaaagaagattgtccgcaaaaagttgcgtgtcttaaaccctttatttaatgcgagtgccatagtaaatccaatcagattcttaaatactgtcgttaccgccgcaaaaatcaatgtattaataatcactttaatgtatctctggtcagtaaaaatatctttaaaatgcgacagcccgataaaatgaatttcgtcattcattgcattccagtccgtaaaggaaagtaccagtcccatggcactcgggataatgaataatcccacatataaaactaatggaatcacgagaaaatatgagggataaatctttttatgattcatgactgcctccttcctttcattttttgagcatagtacccaaaaaccggaactatgctcattttttataacagtcctgtcttgtctgaactgttgctattttttcattctgcctattatttaaagccttcctgtcccgcatctttagcaagcgctcttctgtgtgtgtcaaactcttccagcacctgctccggcgtcaagtttccgacaaacatctcctggcagagttcactgatcttgcttccgtcatagaacagcacactcgcctctgctccctgtgcttccccggcctcagcagcctttaagtcttcaaatgcctttgtcgggcttgcttcaatcccctgcacagaagaagacacatactgaatcttttcatcataaagtttctgcagattttcttcctctgcaaggaagctgaagtactcttttgcctcttccacatgtttgctgtttgcattgatgcatttggtggttccgcctgccgtcagggttacatactggttgtccaccagagggctcggaaatgcgctccactcatccggctcagcctcatccagattgttcttcatttcattcggataagcgccgctgttgataatcatgccgtactcttcattattcatcgccgcataagaattgtcataaatattggacatatggttttcaccgaaataaccggcagcctcaatttcctggagctgcttcatagcctccttaaattccggtacatcagcaaatccgatttcattcgtgttgagcttctcatagagatctggatcgttctgaaccgccaatgcgctggcgccttccatccagtagtgtgtatgccataaatccttaacaaattcatagatcggggtaattccgccttcctcaagtttcttgcatgcctcctggaattcagcataatttgtaggaactttaattcccagtttttcaaatactgccggcttataaagaattgcatttgttgcatctacgccggctgtgttctgagcgtacagcttgccgttgattgaatttccgtcgatggcccactgttctaggtttgcagcccattcctcatcagagaggtcaaccatgttcttttccggattataatctcttaacttagtacccgaataggacataaagatatcggggccttcacctgtgttcagttttgattttacaatggtctggtactggtcgtccgggctcagctggaagtcgatcgcgatccccgtctcttcctcaaacttttccgccagctccctgtctacgtctacaatccagttctgggatgccgccagggtcagggttactttttctttttcatcccctgatccgccatctgcttctttttcctttcctccgcagcctgccataagcccggccgccatcgttgcgcataacatgcaggcaataattgccactcttcttttcttcatttcttcctccatttctcctctggttctcaaaccgttttttgttttctgggcttattatagcttttatttcattttccaaaaatgcacaaatctgaacttctatgtggacatctgtgaacagtttgtattttcaattttttactttacacttctgtttttctgtgattatattaaatatacaggaagccgacgaaatgtaaggaggatgctgaatgaagaaattacatcaaaactcactcatgagaaaaatcacgttctcctatagtattgttttctttttcctgatcattttgctttctattatctattattttacggcctatcataattttcttcagaaccacacacggatttcgaggcagctcgctaagaccatctctaaccagatcgatacacagggcagcaaatttaacaatctagagatccggatcctggaatccgaagaaatcatgaagtatatattcgaagaggcaaagcagcacaatgtcgtcagcgactgggaattccgcaaaaacctatatgccatcacagggtataattatgagttctaccagctgaacattgtgaacctgaatgaatcgacaatccatacttttggtgaagaatattactataaaccttataccatcaccagaaacgtgcaggagaatattatagagccaacactggaactggacggcgcaaaaattatcattccgcccaacaaaggatgcctgtacgcccccgtcaaggatgttcctatcatcagcgtctgccgggcattcagccgatatcccttatccaaaaaagccgggataattgagatccaggtaaaggaagcgtctctggaaaaattgatcaatgacaacctgtatgccttagaaaatggcggtgagcaggttttaatatttgacaataacaataatcccgtctatccctccgacataccgcaggagagactggattattatacctccctggatacggacaacaagaccatgttccgctcttccttgttttctgaaacggaaatcgtaacctcacattactcttccgaaacaatgtgtacggtcatgcttattaccccggcatcctatattttgcagaaccgtctgttttaccttgagatatgcatcggattctttcttttcacctttgccctgcttgtgtttattaccagaaggctggcacttcggatcaccgcgccgattacggaacttaaaaaccggatctccagcctggaactggatcagatcgcggaggaagactatgacaatctgtccggcgatacctttaatgaactggaaatacttaataagtcatattcccgcatgcagcgcaggctgaaaaggtcactggacgatgtcatcagctccagaactctcaccatccagtctcagatgctggcgctgcaggcacaaatggattcccattttctttacaatactttgaccatcatttccattattgccgaggacaatgatgacgaacaggcggcagccatgtgtatcaaactaacaaaaatgctgcgctacataacggaggatatttctcacggaaccacactggcacaggagattacgcatacataaaattatacagacctgatcactaccagattcggaaagggagttgaattcgattatcagattgataccgcacttgacatggtgcgggtaccccggctgattctgcagcccattgtagaaaactgtgtaaaatattcccgcagcccggaccgggttctgaagattgcaatacgtatctggaacgaagatgactgctggtatgccaatatccgggataatgggaatggattttcagaggaggctctgaagattatcagggacagaattgctgatatgaatccggagcagcagcatccggccctcagcatcaatggaatggggctggttaatatttatctccgcctaagactttattacaacagtcagttcacctttcagctggaaaataaggcacctcccgattccatatacggaggcgtatctataaccataggaggaaatctagatgaaacaaaataatacattctctgtactggtcgcagaagatgagccaattattttaaataacatcatcaaaaaggtgcagggcgcctccccggacatccggattgcaggaaaggcggcccccggaatggatgcactggaaattctaggccatacccacgtggatatactgatcacagatatcgaaatgcctggacttagcgggctcgaactgatccgtcaggtaaaagaggcctttcccagcgtccatatcatcatcttaagcggctatagcaatttcgaatatgcgcgcacggcactccgctacggtgttgaagattacctgctaaagccagtggagcaggagacgctttgcggccttctgcgcgggctatgtgcacggattgacgaagagcgcagaatggatggtcgggaaattctttcccttgcccttaacaattctattgattccgacatcccctatatgttcagtgaaggtggatttcttctatttcacataacccttgggaatctgcctccgtccatagagggggcgcctatcttctgtgcagaggataccggtttactctggcagaaaaccgattttgccagatgttttgagaacgccagggaaatcgagcatctctggctgatcgatgagcatctgccgacacagaaattcctcatcctgcatatggacacagcccatttttccgcatactacttttgtatcctgttgaaaaaatatctcacagcctgtttccatgatttaccgttttttgtcctctccagcccggatttgatcccttatcaggatctctggaaaaccggccgccatctgcgctcgcttacccagcggctggcacggccttttgtgcaggaagccaaaatagcggaaagtacagaagatatacaaagcgggcagtccgaaaccgttctcagggatatgcagatcctgtttacactcaacaacgaaaccgcctttctgcaatacatcggccgtgtgcttccggatatcctgcagtccccctccgctgtatttcatccgtgtatccgtctggtctatcaagcaatgcacaatagttttcaaatcagtacgcaggaatgtaccattgcagaagcagaattttgcagccggatacccactatgaaaacaccagaggaatgtatttccagcctcacagaatctctcaaatcactttggaaaaatgcctcctctcattacactggaagcacgctttgcgcacggatagcggagtatatggaaaagaactacagtcagcaggtatccatgaccgacctgtcagagtgcttcggatatacagcatcatatatcaacaggctttttaaaaaggagtatgggacttctccgattcagtatcagaccgttttaagaatgtcccgcgcaaaagaaatcctgctgaaaaacccggatatcaatatcaaatccgtcgcccaatccgtaggatacgaagactcgcggtatttcagccggatctttaaaaacgaaacaggaatgacaccttccgcatggctggaaagccaggctgagtaacagatgaaggggtatgtaatttttactttgagttatgctggtgcctccagtcgtaaatacgccgggaggcacttgtattttttggtaatatagtttttagaattctataatattttttccacttcttttatagaatcgacatactttatgcacatttaccccttatacttgtatttagatagttgataaacaactatctcccccctcataaagtatcgacgtccggggaagcccaggacgtcacactttactctcattcctttagataactataaaaacaacgaaacccctgcagccgatactgcaggggttttcgctgttcttaatgtattagttttatgctcctatccctttaagcaaggtacgcatagccaatcctatccgccgcccccgtttcgggctcccaacttgggaacaagttctttaccgccgaccggatgaaccagccaagcggactgtaagcggcaagccctccatccgcgccaaggcgaaaactcgtcgctatatcccgactcatttaagaatttcataatattttttcgatttctttaatatttattacatactttggacacatttttcttttatactaaagtcagatagttgataaacaactatctcccccctcataaagtaaagacatcttggggcaacccaggatgtcgcactttactctcattcctttagataactataaaaacaaccagaggcccggacagccgatactgtccgggccttctgcttttccttttctccggccctgcctatacctgtctcatcttcacgtcgaaggcctctttacgggcattgtgttcctggttttgattctccggtttcttcttttccgtaacgctgttgaactcatttctgttcttctgcccattgatttcttcctgtttcttcttatccatgtcgtcacctcacagttagtatgttcactagacacagtcatatacacacttattgcatttgccgtaaaaaaagagccggtaagatttccgactcttctgaaatgcactttaattatatctaataaatgaaaaattatattttactttccagccactcgtacagatcttcatacacctgatccctgtcagtctcattaagcagttcatgcctgtctccggcatataagcgcagtgtgacatcctttattcctgctgccttgtacctctcataaatctttctgacgcccttgccgaaatctccgaccggatcttctgatcctgcggctatcatcatgggaagcgtctttggaatcatgtagatactttctttcttctgcatcttcaacataccgcagaacatgtgataataagcatttacggtaaatacaaaggagcagagagggtccgccacatatgcatccaccatcttcgtatcgcttgttacccagtctgccctggttctcggcggcttatagcccttgttgtatcctccgatcgccagattgtcaatcagtttactgcggtaatgccatcccttgaaagcagctataatacgacagagcctcttggcagacttcaacgtgacccgtttcttatccgcgaccactccaatgataatcacacccgtcaggccgttaccatacatttggatgtactggcgcacaagggttgatcccatactgtgccccagcaggaaatacggaaccccggggtacttcgctgcagtcttctgacgcagcgtatgcatgtcccccagcacgcaggcattgccgtacttctcgttgaaatagccatattctgtttttccctgtatggactttccatggccaagatgatcattgcccaccacgtaatagcccttgctgcacaggaagtccgcaaactcatcataacggttaatatactcaaccatcccatggctgagctgcagaactgcttttacttcgccttccggcttccattcaattgtatggatctctgtattaccatcttttgatgggaagtaaaattcatctttcatcttatcctctacctgtcctctaattttatgtaatcacggtgaggcgcgagtggtttatacgccggtcggataatcttatccacgttcttaagctcttccagtctgtgcgcactccagccgacgatacgcgctgctgcaaagatcggagtatacagtgcagccggaagatccagcatactgtaaacaagtccgctgtaaaagtcaacattggcattaacacccttatacatcttacgcttctcactgataatctcaggcgccatatgttctaccttctcataaagagcgtactctgcatcatagcccttttcagtagccaactgcttaacaaacttcttgaaaatgtctgctcttgggtcagaaatagagtaaatcgcatgacccattccatagatcagaccctttttgtcaaatgctttcttgtccagaaggtcggtcaggtactggcggatctgatcatcatcgttccagtctgtcagattctgtttcatatcatcaaacatctgcgtaacctttacgttcgcaccgccatgcttcggacctttcagagaagccatcgccgcagcaatcgtagagtaagtatctgttccggaagatgtaacaacatgtgttgtaaatgttgagttattaccaccgccgtgatccatatgaagcacaagggccatatcgagtatctttgcctccagctcggtgtactttctgtcctcacgcagcatcatcagaatgttctccgctgttgagagttccggatacggtgcatagatataaagatcttcgcctcttctgtaattatatgcatggtaaccgtaaaccattaacatcgggaactggctgatcagattcaggcactggcggagtacattcggtatggatgtatcgtccgctttcttatcgtacgtatacaagttcagtatgcaccgggaaatcatgttcatcatgtccttgcttggcgccttcataataacgtcccttacaaaattcggaggaagcattcttctctccgcgatcattgcctgaaaatcatccagctgcgcctctgtcggcagacttccaaataacagcaggtaggcagtctcttcaaatccagaatgctttgcttccaaaaagcctcttacaaggtctttgatgttgtaaccacggtaatagaggttgcctgcacaagggacttcctttccgtccacgatcttagtagcgcaaacatcggagatattcgttaagcctgccagtacccctttaccatttacatcacggaggcctcttttcacctcgtactgtgtgtaaagttctttctcgattgcattgttgtcctcgcaaatccgggctaactcttcaatcttcggggtgttttcaaaaaagatattatcaatgtctttaggtattcttgccataaaacctctcccttcctcttaaatattcacttgtctgatccctctattatactaaaaaagtgggttttatacaatgaaatgtctattaaatatttatgaactgcctaaaaagagtgttatacagacctacctgtcctgttggattttggccctgttgccggacgggatcatatggcagcagccttccggggatctatctatatgctttttcgtaccaaacagatgaagccgcagctcaaaatgtgagaccggcaccggcaggcactgccctgccggatgccggtctcaccgtcatttgcctccctgatccgcagcattcgaattactttccctaatcagcgaatttgtaagcgccgcgaattcttccaggttcagcgcttctccccgcactccggccccttttccgaggctttctatcgccgcttcgatctgttcctttgtataatccagctcaggagaatttttcatgccgtttgcaagcgtttttctcctctggttaaacgatgcacggataatccgaaacagcagcttttcatcatccaccagcaccggcggctcctcgtaccgctccagccggatcacggcggagcctacctttggtctcggcataaaacagttcggcggtacatttgccactatataaggctttgcataatactgcactgccagcgacagggcgccgtagtcctttgtccccggtcctacctgcatacgctcggccacttccttctgcaccatgactgtaatgctctttacaggcacatgcttctcaaataaccccataatgattggtgttgtaatgtagtacggaagatttgcaaccaccttaatagggcgtcccccgttctcacgctctgccagctctgcaatatccaccttcagtatatcctcattgagcacggttacattatcaaaaccatcgagggtgtcctccaggatagggatcagcgccctatcaatctccaccgcaatcacttttcctgccgcacacgcaagatactgcgtcatggttccgattcccggaccgatctccagcaccatatcttccggcgtgatctctgccgagcggataatcttatccagcacatgagtatctatcaaaaaattctgtccgaacttcttctgaaaagcaaagttatatttttgtaaaacagcgattgtattctgcgggctgcctagtgtcggctccttcataagctcctcctcgttcatgttgttgaacttttctctaaacagtataatatactttcccatgcccggcaacgattatcaaaaactttctcttcctgcagcataagcagcgtaaccgtcccgggctgcctgaaccgttactgttcatcctctcagcattcaactgcatgcaggaaaatatcattgaacttctccagttcatcatacatgatgccgtggccgctttctttcagtgtatacagactgctgccgctgatgcactcatgctgaatttctgcaaggtcattggacactaccacatctttttcgccatgaatgaccaccgtaggcacatgcacgtaacagagatcatccctgccgtcctcatcccgcagagacagcgcacattcaatcgtgccgatagctgaagccgacatcgctatctgccggaaccagtcgataatacatgcgctgtgcgggctggcaaacaactgttggctgaattcctctgcatactgtgcccggtccgtctcaatctgacagatgatctcatcaaccgcttctcttgtcagcccataaggaaatccgggacgctgtgtccaacatggagccgcggcagccagcagaagcagcttctttaccccatatccgcggaacaggcgcatatatctcaggctgatcgcccctcccatggagaatcccactaaggtaaatgaccacaaccgcagccttttcaccaccttgtgaatatctgccgccatctggtcataactatagccgcaccctggaacatcagacatcccaaaacctctcagatccaaagccacaacccggtatcccatgcgaaccagaatcggaatctgatactcataaattttatgggacagaggccagccatgaaccaaaagtacagtctctgtcccgccacagttataatcatataccgctatctttactccatccgtagaattaacataaaacataaagtcacacatctccagtttatttctctacactatatgcagaaagataaaaaactgcttacggcttcacgcccgttaaaatctaacgattctttcggcggccggaccaggcggccggctaagttctatgccttctcaggcatcttcctgagttccatgtatgacaataccatctatagtaagttgtaaagccttctggcatttttttctgtctgttctaccacctcgtcataagataactgcttcagtactgcgatctgctctgctacatagaccaggtttaaagaagagtttcgtttgcccctgttcggaaccggcgcaagatacggacaatccgtctcaagcagcaggtattccagcggagtctcctccaccacttccttcagttttctggaattcttaaacgtgacaacgccccccacgccaatatagaaccccatcttcacgtattcccttgccatctcagctgaataagagaaacagtgaatcacgccctcaagtcccagggcatgttccttcataatctgaagcgtatccgcagccgcttcccggctatggataatgaccggcatttccagctcccgggccagctccagctggcggataaaccatttcttctgaacctcatgactctcattgtcccagtaatagtccagcccaatctctcctaccgcaaccatcttttcttcctggagaaccgcccggagcctcctaaaattttcttcattcagttcccccacatcatcggggtgcactcctgctgccccgtatatgaaaggatatcttgcagtcagtgccctgacatcctcccaggatgccacatcggaacctgcattaacaatagtcccaacgccgccctcctgcatggaacataaaagggaatccctgtcctcatcaaactgttcatcatcataatgtgcatgtgtatcaaatatcataagtgacctccctggtatacaatatcatataaaaaccggaccctgcataagagggtccggccccaatcgcttccacgattatagcacaatatcatccaccttttcaaatgtatccatccggaaagattcaacagtattgccagccactagatagaaagtatctttgctgaacattccgcgcccttccgaatatccgctcagttcccgttcaaaaatacactggaaccctttttccttgtcgtaggagaacaagtaatacttctggctctgtccgtaagcagcaaatccgatcagattcctgtccgtattaatcagagccgctttgtagttgtaagaaacgtttgtagagtaacaatcctccatcacatacttttcgatctccttcacatcggagggatccgagatatcaaacatggacagcttcacgccctccgtagtggttcctgtctcatccacatccatcccgatcccgagcagcagcccctcaccatatggatgaagataatccgagaatccgggtatcttcagggccccgatcacttccggcttctccggattggacaaatcaacagaaaacagcggatccacctgcttgaatgtcacaaaatatcccgtgctgcccataaacctcgccgaatacacctgctcatcttctgcaagcccttcaatttttcccagttcattcaaattttcgtccaatacatagagtgaattgctgtccttctttgtggatttggaagaaaacggggactctccaaacgttacgatcggaaacgggcctgcactgcctgtagggctgactgtagttaccagccgcagttttccctcatactcatcaatactgaacgaatcgtttaatgtgccgtcgatccgcgtctgtcccactgcctccaaagtaccgtccttataagccaccttacggatacaggtctgtgttacatcggactcctcggaattataataggattcacaaacatagatgctgcttccgctaacatacacaagcccggaacttccgaataccgctttgctgtccagcttcctgccgggatccttcagggaaaaagcagagatgacggtatactggtatccccgcacatactgcggcagcagaatgcttccgctgtcaatggcctttccctgcacctggggaatgtataaatcaatatcgttccttgcagccgaaacctcggcgttaaaattgctgaacaggtatacatagtctcccgtcacacgtaccgtataaaagctgccgctctgtgtaatctttcccacagatttgggcttctccgggttgctgacgtcataagtctctgccacagtgtactgcttgtaggtaccgtcatatccctcattgccgtcattgtactcggtcttcgtatacacaataagcagtttatctccctttatatagatctcagagatgtactggtcgtcctctagcctgattgatcccatctccttcatctctttattctcaatgttgacaatctgcaccttctgcccattcaagatataaagtttcttaccgtccgttttaacgatatccccttcctcaacgccctcttccctgatatttgtatccgaataggacgcgccgctgtcggcagcccccgccgcagatgtatcggctttgctctcggcagattccgtgcgtgctaaattagacgcactgccgtcggcggcactgtccacactatactgcttctggagctcctcctggctctttttctccgcctcgatatatttataaatctcatcatagtccctggcggaagctataaccgtatcagatgtgcccgaggcctccgtatccgccttggcttcattcgttcctcccgcgtcagcggcagaagtactctcagtatttaacatatctttatgacccccaagaccgccaaaaacggcaatccccacaacaatcacacagcaggctgctgctgcagctgcactatacgctgccttccaccggaaaggtttcttcccgcctttttcagtcagcatcttttctatattctccggttttagagattcggggatctccacatcatctgccatctcccggatctgctcctccacagcctgtttttccacccgttcttctattttgtgctcatcggtcctctgttcttctgttttgtttcccctcggattctctctcccattcttcccgtttaaatctttcccatccaaactcatatctacacccctttctactgcagcacacggcgcatcttatccagcgcccgcgtcttcttcgagcggactgtggccgggttcatctccatcataccgccgatctcgtcgctttgatacccgccaaacacggaaaatgccactatcatcctctcgtcttcattcaatatcaggaatgcttcacgcacatcatgagcgcctgcataatccctctccgccgccggcatctctgcctccagctcttctgtatgccccgtatcccttaactttttcctgcacctgttactcaaaatcttaaaaatccaactccggaaagacgcttctttcctcaggctcccaatattctcataggcagatatcacagcctcgctgaccgcatcctccgcatcctgcggatgtttcagcatataaagtgaaaatttatacagatccacataaattctcgcgtacagttctgagaatgctttcacatcacctctgcgggccttcctgatcaagatcagttccgaacagctctcataatcatacatctgcacccctcctctcctgctccgtatcacaggagcagttataaacattcatgaatgagaacgaaatagatattatattccgttcatacatataagagtatcataaaccatggtttgttgcattggaaatgttttttttgctgcgggcggggatgaacaaggggggcgcttgtggggagcgggagttccgggggcgtggggaaaacttctgtgcacctttttcaaagcgggctgcttgccaagtatcactaaataaaaaccacatcggatggggaggcagcgaaggcattcaccccgcaattctgatgaattgtgcggctcatgccttcttaaatgctgctttggtgagcagcatttagcctccacatccgatgtggtttttattaagtgatactacagcgcgctctatgctttcgaaaaaggtgcacagaagtttcccccacgcccccggaactcccgctccccacaggctgggttcatccggacggcagggcttgtatttcccagcagcaccccatccgctctcgctccttatcctttatagtagttgatgaggcagcctttgaggatgatttcccgttctgcgtctgtgagttctcccaggcagaattctgtttctttgaggctgtcgcccactacgtatgcttttatggtgtcttgtttttcttctacggcttttctgacatcggggatgaagatgtaatctccgttcctgaatggcagggactcgtgattttctttggtcaaaagcgggagcattccccagttgatcaggttggaacggtaacgctttgtggcatactcattcgcaatgtttgcccagcctcccaatactttctggcaggatgccgcctgctcgcgggcagagccgtctcctggttttactgcaaatatggcgcttcctacacccaggtttccttctcctgctgacgggtaggattcctggatctttgccatcaccggtttcagctcctcaagaacgtccagcgggcatgtacctgcctcgattgccttttgggctgcctgtacttctttggcgcgggctacgtatgcagggtcttttctggacagtgtaaactcagcaaggcccagcggattggaacggtaggaagaggtctcgcccgatgggatcagctcatctgtggtggttaccggatcatggatctcggaaacgatctttacaaccaagttctgtggtaatgctgacatggccggccagtctttgatgttcgggccgaacttgatctctacatccgggtctgcctcacctttgctgtcgaatacccggttctcatatatgctcttgtcaaaatgatatttctgtcctgtatattcgacatccaacgcagtggccggtgtcaggaatcccttattggcagctgttgcagcaatggagcgtgcgtccataagggccacggaagcaatctgaccgctctggagcttggaaccctcacggttcgggaagtttcttgtagagtggcggatagagaatgcattgttggccggcgtatctcctgctccgaagcaggggccgcagaaagcggtctttacgatggttcctgctgccattaagtctgcaaccgccccgtttttaacaagttccatgtagatcggagtacttgcgggatagacgctgaatgtaaattcatcatgtccgatatttcttcctttgataatgtctgcagccgcacagatattttcaaatccgccgcccgcacatcctgcgataattccctgctctacatataatttaccgtcaaccaccttatcctggagcgtatagtctactgcaccgtccaggcttacaagcgccttctgctcaacatcgtgcagaatatcctttagatttgcgttcagttcatcgattgtgtaaacattgcttggatggaacggcattgcaatcatcggcttgatctcgcttaagttcacataaaccataccgtcataatatgctgctgcaccaggattcagctctttgtaatccccgcttctgccatggatctcatagaattcacggatcttatcgtcagttttccagatcgaagacagacaggttgtctctgttgtcataacgtcaataccgattctgaagtctgcgctcagcttgctgactcccggtccgacgaattccatcactttattgttaacatagccatttccaaatgtcgcgcctataattgccagagccacatcctgagggccaacgcctttcatcggctcaccatccaggtaaatcgcaatgactcccggcatcttaatatcataggttttgttcagaagctgttttacaagctccggaccgccttctcccatggccatcgttcccagggcgccgtagcgggtatggctgtctgatccaaggatcatctttccgccgcctgccagcatctcacgtgcatactgatgaatgactgcctgatgaggtggtacatagactccgccgtatttctttgcacaggtcagtccaaacatatggtcatcctcgttgatcgttccgccaacagcgcacaaactattatggcagttcgtcagcacataagggatcgggaatttctcaagccctgaagccctcgccgtctggataatccccacaaatgtgatatcatgggaagtcagtttgtcaaacttaatctgaagatgttccatgtcagatgatgtattatgctctttcaaaataccgtaggccatcgtattctgagctgcttcgtcttttgaaaccgggacagaaacactgcctgtatcttcaactatttcagtgccgttcagcagatagacaccattatcgtatagctttatcatgttcgctcctcctaaagatacttgattttaatcgttactgttaatcattttagcatgttaaagaatggatgtaaataacggaagcggcaaaaaagggcgatgccgccgatggcaccgccctttttaacctaattcgtttccctgagaatcttcactacttcaagatcagtttctcccattgatataatatcttctttctgaatcacgattggtttctgaaccttctttccattcaggaacgtatggttcttagaaccttcatccctgagaaacagcttatctttgctcctcacaatggcgcagtggaccttagaaatcttcctgtcaccgggcagggaaagaaattcctcaaaagcaacatccttcgtcgttcttccaatcccgatactgtcatagaaaacgaaactgtaacgctctcccgtatccggatcctccaggataatcttccagcgcctttttttgcctgcacccgctgcaggcgtcttcggcggctgtccgacagcctgttttttctttctcaccggaggcctgtcatcgtaatcatcgtcgtcataatcatcgctttctccgccgtaagcctcatcaagctcataatgcctatattcttttctctcttttactatggtcactatggtaacaattatagtaaccgctatcaaagcagctaaaactatcagaataatccagtacatcatatgtatatccactccttcaagagtttatagtactatatttttacctttcaggcaacccaatccgccattttttatcgcctgagcctgaaattgttactgttcacacccgttgggcgtgcacagtaacaaaatgaattccccgttcttactgtcccggtttctattcatattcgcagatataccccaggaaaccggtatatgacgattctgccgccagcatatcgtccggcacgtcattccatacaaaccgcttttcgccgtcatagaaaaacaaatccatatactgctcttccaggctgccgtcctgaaaacttggctccccgtttttccattcgtcagaacaccagctgccctcagaattcagcttctccccaaacagcttattattctcattcacccaataataatctttggaattgtcgtctcttcttcccccaatccggaaaaagatattggtcatccctgccctgctgatttctttacgtatgtactcgtattcttctgaactgttaattctggcaagataaccaccccggtttaagcagtcctgaaacgcctctgaccaggtgcagtcgctctttatatactcgtatctgtggattgccgtatcatcggcaggagcagaagcgtcataggtgcctgcattttgatccgcagcattttcatcctgagaattgtccttggagctgtcagttccttcgccggcatgatcccctgcattgtcccccgtattattatttgcgggatcctttgtcccattatccttatcggtgttggaagcgtcaccctgttgtgccgctgaattcttatcctgttccgccttccctgcagcatcatttgaagttaccttctggctgtcctgcaccttttttccggtcacaatcccaagcccaattcctgctgcaaatacaacgataactccgataatgacaatcaccagtatcttcccgttgtgtcttggctttttcatcttttgtctcctcccttttcttcatactgaagttttcccaatagttacttatacccaaagagcacccagcaatttatgcccctttgggacgggttacagcaagctgcaaaactatgtatagaaaagacagaagcctctgattctaaggcttctgtctgctagaacttcctacaatctatccgtatcctgcgcctgcacgtcctttgccgcagcagctcccgcagcgatactattttataatctctttaataattcttctctttcttcttcataacccggtttgcccagaagtgcgaacatattcttcttatagctttccacgcctggctggttaaatggattcacgccgagtaaatatccactaacaccgcatgcaaactcaaagaaatagaacagctgtccgagataaaactcattttgctgtggaactgtcaccatcaggttcggcacgttgccgtccgtgtgtgctagaatcgttccgttcatagcacttttattgataaagtctacggtcttgcctgccagataattcagtccgtccaggtcaaccggttcttcgttgataatcagctcttctctggacgtctccacattcagaactgtctcaaataatattctgtttccatcctggataaactgtcccatggagtgcagatcggtcgtcaaatctactgatgccgggaagatgccccgctggtctttaccttcgctctctccatataactgtttccaccattcggatacataatgcaggcttggctcataattagccagaacctctattgctttgccctttctcagcaggatattgcgtactgccgcatactgcagggccccattatctttaaaatcattttccaaagcttcttttcttcctgcctgtgcgccttccatcagtttatcgatgtctgcgccgctcactgcgatcggcagaaggcctacggccgtcagtacggagaaacgtcccccgacatcgtccggcactacaaagctctcatatccctcttctgtagcaaggttcttcaaagctcctctggctttgtcggtcgtagcatatattctctttgctgcgctctcttttccatatttattttccaaaatctctttaaatacacggaaggcaatggctggctctgtagtagttcctgattttgaaatcatgttgatggaaaaatccctgtcgccgactacgtcaatcagatccttaagataagtactgctgatactgttacctacatagtagatctccggagactttctgagttctttggataccacattggcaaatgaatgtccaaggaagtcaattgcagctcttgctcccaaataagagccgccgattccgattaccaacaacacctcagaatcactgcggatctgctctgccgctttcttgatccgtgcaaattcttctttatcataatcaaccggaaggtcaatccatccaaggaaatcatttcccgcgcctgtctttgcaacaagcttgtcctttgcctgggctgccagttcgctcatatattccatttcatgttcctgaataaaactacttgcttttgaataatcaaatgtaactttgttagccattgtttacccttcctctctaatatcgtcttttacaagctaattctaccaaatatgcccaccttaatcaagctaaaaactcctctaaaatttggcgaattgcctcttcttttagtgcaggctgctcatcatcttcctccattttttcttttactgtccggcggatcacctgtctcgccgcttcccctttttctaccctgcgcggttctccttcaatattgatcgacagtgcaggttcctcccgctgtgccgccgctctggatgcccccgcagtttcggggctgataacatctatattctccttctcggtctgtttcaccttcttataacggtgagcgcagacattttcaaggtaatcaaccatataattctttgctgcttttactttataagattcatcggacagctggctgattacaaacaacgcaaccatttccgccgcccctactgcaatatactggtacatcgcctcacacagcccatgtgccaggtagtgccctgccgctcccagcgccgccaggattccggaaaaccaaatactctgtatttccaattgtctccacgtatgtactttaaaaagaaatccccggtattcatatatgtacttctccacaaatgctcccacattgtctaccttatcgtgtatcatacacgcgtgctcatattttgcccgcacgagcttcatcagtttgtgtgtgctctttgacatattgcctgacgcctttaccagacggcggagggtaacctggttcacgagcttggccagtaccccaatgacacccaccgcaatcatcagatagaagattacgtttgtgtcggctgctacatttttaaacataataagacctcctgtttttatggttgtgccacaactaccattttttggtgtgagcctattatagcccaacttttccgtacttgccgcaaaaaccgttctacataattcgccatttcagagtgtttttaaggaaagacaggaatatctcagggttaagaaacatagaatttaagaacggcctcaatccttcaatttaacacatcatttatcttcacagtgcattctctgccttaagaaaactcctgtcatttaatcggggaaaaactcgaaaattggcacacgaaaatgtactggtaatttccccttcattttgctataatcaacatatctgataaatgctggtaaaatacgggttatagtgccgccataacaccccaatgccagattaaaatcattatttgcaggaggataaaaacatgcagtataagacaagcggagtctgttcgcaaatgatcaacttcgatatcgaagacaataaggtaagaaatgtagcctttgttggagggtgcgccggcaatctgcagggcatagcccgcctgatagaaggcatggatgtggatgaggctatctccagaatagaaggtatccgctgtggtttcaaaagtacatcctgtcccgatcaactcgcactagcattaaaaaaagcaaccggaagataatccgattgctttttctatgtttagtacatgaaccatataataaaagatccccctccttgaacaattgaagcagctgtcatgcggcgcgcataaaaaaatttgtggtgttttctcggtacaggtcttttctataatcaattaatggttaatagtttctcctgtatgcggtacacttgacagctgcttcaattgctcaaagagagggggtacagggtggtaaagttaatattaatttacgtagataccgtcggtgagtgaggtggcttcgtcgtatggcttttctgcagtcattccagctacatgatctgcatggactctataatagtatccacgatccaccatcatcattttgttagtgcttacataatatgtattacggtcctctacctgccagcagtctatttgatcccatttacccgtttcttgattatactgatcaacataaataactgtagagatgtaatctactacatgatctgctgttgtagccgcatatacgtatattctaccaacgcccgactttgttatggaacactctccatccatcaaatgttcgcctcttgtcactatactcccatcagtattacctgttgaagtatctagtgtagtgagatatgaaccgtcaacttttataaccttatcttctgaagctctaacatccgttacagatataacgcaaatacttaaagctaataacaatgtagataatgtggcaaatattctttttctcatccttatcatcctcttatgtgttctattaaataaacaattgagtgtattaaaacttacgcctttaatcaaaaaatatcaaattttctattaatcctaaaaattcgtcttcttccataactcctttaacttgataataaaccccttgataatcaaatttagctacaaatctatacttatttgattttttatatttttttatatctatgttttgattatggttttcaattacaaaactatctattagcgtgtcttcctctttttgacttaatgatgaatctaaattatttaaatatatagaataacgtataatctcatcattatatgaataaaatagttgtgctcttttctgctcttcatctatagtatattctgataagtacatatctttaggcttactgcccagtcttactgctacaacccccagtcgctctctaatttctctatatgcagtaacttcctcaccatcttcggattcttgtgtttccatatctttaacattaacaacttgcattgcctgtccaccatgaatcttctcccatagtattttcaaatatgacttactccccacgctagtcacactcgttccaaccaccaaaacaagtaccgccgcaaatgcaattataaacctccttccacgcggcatacgtaatacactggtcttcctcccttcttttttcttcccctttttctcatcactgttaagatgtttgtggtattctgtattgacttcaaacagctttggttcgtcctctttctttttcaggagttctctgccaaggcgtaatgcttctctgtcttcttctgaaagaaaactttccggattatcttttgtacgttcggtaaaatttggagcaagttcctccccaaactctgctgtattttctccagtgctgtgctcttgtccacgtctcttctcgtatgcctgaatttcagctagaagtgcagcttccatcctgccagatacctggatatctttaagatcaggattttccgctattttcctttccaccctctcagctgcattctccacttcttcttgcagtgataattttttgttttgtttcatgcttattccccttattttggctactactttttcttgactttttactaaataagtttaatatgaaattatatgtgttttatcggttatatgcaagtataacttttaaatttttaagcataatatgaacatttcaaatctggaggttttcattatgaaaagaatcatactcaccggtggaggaactgccgggcatgtcacccccaatattgcactgattccccggctgagggaactgggttacgatatccaatacataggatcttacaaagggattgagaaggaactcattgagccttttggtatcccttatcatggtatttcttccggaaagctgcggcgctatttcagcgttcagaactttacagatccttttcgagtaataaaagggtttggggaggctcattccattataaaggaattgaaacctgatgttatcttttccaaagggggattcgtttctgttcccgttgtactggccggcaagcggtgcaaggtaccgaccattatccacgagtctgatatgacaccgggacttgccaacaagctagccatcccatcggcaaccaaaatctgctgtaatttcccggagacccttgagtctcttccgctggaaaagtctatccttaccggttccccgatccggcaggagctgctgtccggcaacaaaattgctgcactggatctatgcggcttcgcggcggataagcccgtcatccttgtaatcggaggaagccttggctcagtggccgtcaacaatgcagtacgccttgctctccctgagcttctggagtatttccagatcgttcacctctgcggcaaaggcaaagttgataattcccttaatggcctgagaggctacgcacagtttgaatatatcaaaaatgagcttcgggatatattcgccctggcagatatcgttatttcaagggccggtgcaaatgcaatctgcgagctgttagcacttagaaagccgaatcttttgatcccactttcggccaatgccagccgcggcgaccagattctaaatgcccgctcatttgaaaggcagggctttagtatgatccttgaagaagaggagcttacaaaagagtctctcctcgaagctgtccggaggctttacgataaccgcagttcttatatggacgctatgcgggattccagacagcaggattccattgatacaattataggacttgtagaagagataagtttatagtaattgtcggattgcaacacaaccaggaaaacaggtggcgtatagacacctgttttcttatactcggttcaattcgtcatattctacgccaaactctttctttatccagcttttggctctgtgcaatacactatgcagcacttcgacacggactcccatttgttcagcaacttttgcctgtggtatttccagataatataccagcgtaatcgcctcataccatctgggatttttctcaagcagtgcctcaaagatacgctcgtgaagttcggagcgatctaaatctttcaactcttccataaacgtttcttcagcactctccacagtttcccgaacaaagtcttcctcattaaaattttctccaagtatctcccgactggccttcttgttataattcaacgcgtaattcttagcagtcgtatacagccacgatttaatattgctgtgattcatgtggttgtaataaatatataattggagaaacgtattctgagtaatatcttctgccacatcgtaattgcccgaatatgtatatgctgcttttaaaacgagatttttatattcttcatagatctcatcaaactcacgattatcagtcaacatttttatccccggttattaaatcactttacttaatatttcttctttgtcctcatctgaaagttcgcccatcttccagcccaatcctactttatcgccttcatatctaggaatcatatgcatgtgaaaatgaaatactgtctgacctgcgggctcctcattgttttgaacaatgttataaccgtcacaccccaacacgtctttgagcttaagtaccatctttttagcaagaaccaataccttagctgcaagctcatcatccaggtcatacagattgcggtaatgctccttcggtataatcaaagcatgtcccctggacgcaggattcaggtctaaaatcacacgaaagtcatcgtcttcatacagcgttgctgatggaatttcacccgatgccagcttacaaaaaatgcaattttcgtctttcatagcttttcctcatttcttcttttagaatgttttaactttagtatatcccattttcaactaaatgagaagctcttttatcagcattattctgtcgaaacttgtcaatctgattttgttgaacactgcccaccatcgtgctagactacaattataacgtactataaggagggcataaatatgttacataatgttgacatcaataaaatgaacactctcatggaggaaaaccatgatgcaaaacagatcattagtcagctgttagaaaatcatcatgaaacggtgtccgcaattgctcatgaaatacgaaatccgctgacacttgtttcctcgtccttgcaggttatggaaatccagcatcctgaagtacgtgattttccacactggcgtcagacgatcgacgatgtagaatttatgtgtcagctgttaaacgagctttctacttttaataatggcgatactctgcactattctgtcttttctatcgaacgtctcctaaagaacattgccgtctcatttgcaatttctatcgacagcgaagattccgatattgaattcacatcctctattcctgccggtctgggcgattacactggtgacaaagtcaagctggaagaagtattcttaaaccttcttcgaaatgctaaagaatctataacaggtgaaggccgcatacatttttcggccagccgtcataatgactctctgacaattcaatgcaaggataccggatgcggtattgcggaagaaatcatagattacatctttgagccgtttaaaacctataaagagggtgggacaggccttgggctgtcattgtccaaacgaatcatcgaatcccatggtggttccatatcggtagactccaaagtggacgaaggttccacgtttacaattattcttcccatatagtacggtattgctgaattaattaatcatagaatactgtaccagccgcgccacgctgcctgcggtacagaaccgccgccatcacaaatccgcagacaagaccgccaacatgggccgcattgtctactcctgagcttgtaaagccaaaatacaggctcaggactaccataaccaaaagtccacggtttgtcagccttcccactcttccatgatttttcaagactacgcacagcagcgctcccatgagaccgaatatggctcctgaggctcctgccgataccaccatcttatctgtactcatattcatccacaatgaaagcagattcccccccagccctgatataaagtaaataatcagaaacttgatccggccggtctccagttccaggttccagccaagtgctcccagcagtaccatattgttcagcagatgttcgataccaaaatgcaggaacaagcaggtaaagatccggtaatactgatgcccttccacaacataaggcccgtacatagccccatgctcgagcataaacagggtatcttccgtagctcccataacagaaagcaccagaaatactccaatattaattacaatcaatgcggtggtgcacactgctttttgatttttctccaagatgactctccttttcttaactgctcttctatattataatagctctctgcccttctgtctatgaaagaatcaagcaccttatccgaaattgtaaatattttactccgaatgagatgcttttgtattttatcatgtatccttaatttattgtttagattttataacctcacatatcctcttcttccttcccgttcgtctccagaatcaggtccttccagctgccccattttgtcttttttaaccgatctgcagttttcttccatgggctccaatgccctcccatctcccggattgtctccacatcggcaaccggttcatattcttcttcctcaagagaaaacagattttcccgggacagctgctccccgtcctccggggtatccgcatttacaggttccggcccgcgtcttttttcttcgtgaatccggtattcctccataattttttcaagatcgtaattttcctgcagcgttgctttatgaagctcataagccagcataatgccttccgtatcctcataatcaagcttccggacaaaatattcggttatcacatggaaagcctcacagagggactttttcctgccgggcagataacagaaatgccaggtatctttaccataaaacataaattcagggtagagtaagagtccgtccggattcagcataaaacgccggagcgccttaaccacttccatcagacggttcacaaatcccagcatatcctcctttttaattgcagatgcctcaaataaagatttcatcgacaataaccccgtcaccgtgtaactgtatctgctcttcccatccatcccacaccccgctatttcaagcagaccgggtattttattttcccggagcatatgtatctgataatcctcttcatacaagcgggggatatctatatgcaggcttaccctgttcagttctttttcataacctgtcttcataattatctattcctcctggtctgtcaatgactctaagtgtcttttctttcttatctttttctccggtcccggtatcctggtgatctgcactgcctgtacacgcatcctgcccctgcctgcacgggccgtaactctggcctgggttttatccagctcaacttcaacgtctgtcagcctcagccagatcagttttccctccgtacgctcctggtaaaacctctgcagatctggttctccgccgccctgctgcctgtccgactgggccgccagcaccgccgtttctgctgccgcccccagcaatatgtttttgtcatgccagtagaatacgatatatatcgtcaaaataatcacgaaaattacaatcggaaaaatatatgccatttccactgtcacgcttccatttagctctcttttcttctttaatacgtcttccattttaagtctcattgtacgccacacatccatagaaaataggacgccagcaaaaacggaataaacggatatcccgcctttctgtcaaagcctttatataccaaaagggccgctgcaaacagcgccgaaaagaggaaagcaccggacaagacagccagcagattccggaaccctagatatacccccataataagtatcagtaggctgtccccatatccaaagccttcctttgttaccctgcttaccgctataaataccacccctgtaacagcacccgccagtgcggaaaaatcaagagtccccgtctggcagatacgggcagccgcagccccagcccctcccgccgcaagaaaccacagaggaatccttctggtccaaatatctatcactgacaagatgcataagtatacggcgcatcctattctgcttatttcgagcatctgctgcagcctcctttcaagccaacttcagacttttttactgcatgtatggttcttttgagtccactgcagcttaatgaattgtggtactttcctcctgtatttgtaatataaactccggcgaaagcatctccgtgtacgcatttttcgcatctgtaatacctaccgccgtcctcgttgcggatcccggaaagtcctgagtacggcacaaaccggactgacagctgcagatatgtacattggtagtcctcgtgataaaccaaagctgtatccgttatatatacaatctcctctccgtcggaatttccatccctttttaaataaccggtccaggcctttaccctcatttcttccctgaattttgctttcagattcgtgaactgcggaaagggaagacttacggcatattccacagagacatgaatctcccccgtaagtacagacatatatgtcctgctgcagttaagcccagaactgcctcctgccagaatactccgatccaggcggccagctcccgcggcttctacgatatcctgtcggaattttaccaggttcacgacaggcagcataaccgtatcctccgcggctgtcttagctgcgctctgcacagcgtttcggatacatgtccttacagattgtatttccagcaaatagaccaggctcaataccgcgaataaaaatatgggaaccgccagtgccgcttctatggtaacgcttgcttttgaacccaatgcagatgccctttctatgttcgagtcgggtgagttttcatttgattgtgtcatcgcagtttttcctttctttatatttttttgattgggatatatttgcctgccggaagggatgcgccggcagggtttgaagaaagggcatctgcattgggttcaaaattttatctgtatccaaaatataacggaaactggtaggtcagcccctcacgaatgactgctttattctgaactcttaaccggacgatacaggcgtctgcacagaaagacaaaccgcccttttcagttctcatgttttgttcgacacggtccagcgccttcatgaccagaacatcctcctcttttaaaaaaagaaggattctgaggtaatctgtataggagagtcccccctcggtatccgcaccttcctgcagatcctcccccgttcccagtgtcataagagacgagagcgacagctgccagtttgtgctgtttttcaccagggcagcttttttccccgccattaaagaacgcagatccatcaggctctctccaaatgcccaggctgcaaggagcgcttgtttcacaattcctgatacagccggaagcgctgcaagcgtcgaaagactcagcgccagcgcctcggcctcggcctgcttcgcagtatctgtctgcagataaagataattaatcccaaaccggattccaagaagcttcttcacgactgcttccagattctcccggtccgaggcacagcccgaaagtatgtattccatttcatataccagactgcgttttccacttacttcatttaccgcgctgccaaattttttaatcagatattcatgaaacagcagccgctcttctatgccttccatcccctgccttgtatagaaactgcccctgccatatctcagcttccttccactgggctgttctcccggagcaatctgcccgtttgagagttggtaatcctgcggcagtacgagctgaaggattccagattttttcagttcagctacatgcggcagaggattttcctcatcgggcagcgcattgccactgtctgccaaaatatcttccagttccgtattgatctccgaattctgcctgtctgcttcttctccctgcatcttttgttcctcccatattccagtccggtcagccagctcacgtatggccgctattccgtatgtctcttccatgtaggcaagcgcctgctctttgaatgcgcttccgtttctgtcagtcaggtactggatcccctggatatcatgttccataccgcttgtgccatagtagtgcatacggtctgtcagatatttctcttcataagaatccgcgccatagcttccatcaattgccaataactcatattcttccagaagttctctgctatactcgccaaagacagagaacacggcgcggtcggcatccagacgttttagatttttagccacctggatagatgtactctctagaatcgctgtgataaatgagataagaagaacaaaaataagactcaaaaatgccgttatctcgccccgcttccccattaaatacccgaactttcacttgttatcttttcaaaaattgagttcaccaggctgatcagctgggttttaaatatcaaaactaaggctataattaccaccagtattaaaatcagctctacgacagacagccccgtagagtcacataaaactacttttgccctgcccaacctctgttttaatctccctacaattctcttcatttgtttcctcctctcagatctgtatcgtaaaaaatgccggaaccacaatcataatcagtaccaccgccagcatcaggaacatcggccccaacatctttgttccggcttcctcccccaacttcctggcctgtttttttctgtcctccagtgcatccgcggcttcccttttgagcaattcattcatccccctgccccctttccgcagattctgtgacaaaagtgcgccaaaccttcgatacgccggcagaccgcacctgctgccaaaccgttcatagcattccccctctgtgacgccgccctgaatctcgtgcatcgtataggacatttcctcataggcaatccgggaaccttttctatcccttcttttttcatactcttccaccatcttgaaccatgctttgcgaacgctcattcccgctcccaggaacagggtgaactggctgatcagctgtggatagtctgtggacaactgtctcttccgctcctccaccatctgtttatgtttctgcctgtccagaaaaaagactgccgctgccgccacgattcccagaacgaatagtcccgctgccctcgactctcccggatatttccatgttattttactcccatccacgctgcccggcagaatcaaatatttttcttccggttcggccagctctgcctcccgcagtgccttctgtagtttttgcatcttttgttctttttcgtttaacctgggaggaaagacgtttacataaaaggaatgtacagcctcctccccgccatatgtaagtactgcacgcagctcaaccaacgtaccttcttcctgcagatgttcctgctgcagctcccccagaagattaacgatttcgtaatttccggactcccacgacacattaattcccatacccggcacctgatccgccagtttcagattatgcctgacttcatccaggctctcattttctcccagcacagccttttccagtcgttctccggccttcttaaatatctccggaagttcctctttctgataccgctgctcttctacctgtacagtcaacggcgccttgtctccgtctacccgggcctccagttccacctttttacttccctcaccgtggctgccacgggcaagtacactttttccttctgcatttttctccggcctccggcggctgtcagcagccagcatcaggagtgatattacgcttgcagccaaaaagataattcccattcttccatacactgtgtttcgcttcttcataatctacacctctatatccaccagcttttctcccatccggtaagcggccgcatatatcagcagacatcccgtcatcagcgcggctccccccagattcccgtaaagcaccttcataaaatccggaaaagccattctcatataaaacagaatgccaaatggtatgatacacatcacctgaaattccagctttttagaagctagaagcgtctgtatctccttttccgcttcaatcttatcactgatatccctgaccgcacttttgagtatcgctatgctgtcccctcctgtccgctttgccgcagcaaataccgttacgaagttctctacatcctcctgactgaccctggccgccagatcattcatgacctgttcaaccggctggttcatatccagctgatggatcatccgctcaaattcttttcgtattctgctgtccttccgaaacaacggcttcaaatcccgggcagtctcgcgcagcgcattctccacggaatatcccacgttgagagccgatgccatggtttgaatactgacccgaaactgttccctgaattcctgctcttttttccggaactgcctggacttccagtagagcagatagacatataaggcgggcagaagcgccagcgccgcaatccacgtatcgtagaaaagatatgcggtcatgcatagaagcaaaatcccatttatcaatgcctgtatatattccttacagcgtatatcctgctgccagcagcttttcccggttgacaagctcttccactttcataagccgtcctttaacttttccatcttctgatccctcctcctgatacgcaaaaagtgtctgtatctgtacctcaccatcttcatagcccaatacttctgctatctccattacttttctgcttcggtctctcagccgccccaggtggataataatatcaagggccgaagccacctgccgctggattgcggtaaaaggcatatcaatccccatcatcatcatcgtctccagacggtgcagcatatccacgcaattattcgcatggccggtggacatagaaccgctgtgcccatttagcatggccgaggaaatcatatccacggtttcctcaccccgaacctctccgaccaggattctgtccggacgcatccgcagtgccgacttgatcagatcccgtatggtcactgccccggatccctccaggttggcattccttgcttccagcctgaccagattgggaacgcctttaatctgcaactcagcattgtcctcaatggtaatcagccgctcatcttttggtatataatcagacagggcattcagaaatgtggtcttcccggccccggttccgccgctgacaaatatgttgtacctggaatgcaccaggagctttagaaaccccaccgcctcgctgcttatgctgccccacgcaataagctgctccattgttaccttctccttgggaaacttccggatcgtcataatgggaccgttcaatgcaacaggttttaataccacattcacacgggacccgtcctccagcctcgcgtcaacaatgggggaggcttcgttcacataccggtttgttctggatacaatctgctgtatgacatcctccagctttcccggagaaaggaagtgcctgtccgattcgtatatctgtcctcctttctccagaaaaatatgatctgtgccgttgatcataatctccgtaatatcatcgtcctcgatcagatcctgaaggatatccagctttctgaatgcatgaaacagttctctgctcagcttaattttttcctgcagtggtatgtaagtttctcctcccgcctgattgagtacggaatgtatgagatccagcagttcatcatcctccatctccctgcccatatccatctcttgcagcactctgccgtataactcttctaactgctctatgcctcctcaccagcctttctcgcaacccgtttctgtacggtatgttccagcacatcctcatagcccgtccgcctcaagttctcaaaatactgcttcagctttgccgaagaaaccggctcatccgtatacaacgtatacactgtgcggcattcccttagtatgcggtacagaccgtttacaccgtcccccagatccaagatcacggatttataaatggactgatcaaaaatggcttcaaacagtcttagccactcagcctcttcaaccgccctcagatcctgaataaccggcatcggagaaagataatccagtgcccccgccctgccggccatggcgcttattctcagtccaatattcgccttatcctgcctcagataatacaagagatccgtcaggttatgctccgtttcctccggaaaataatggcttgtcccggaatactcctccagattcagatacagaaccggcccttctttggagagctccctgccaagctccagcgcaaactttgtctttccgatccggtgcaccggagaataaacaccgatcagctgcccctctcccctgcctttgaatctccccggtatttcctcaccgtccaaggcctcctccaggataaggctgaggatcctatctgcagattgatacttaaagatccccctttcttccggaagaagcccgctgtcttcccccttaatcaatacgtaacgcctgtcagcgttcatctgctgcctctgttcgggcgggcagtcttcccccagcagcaggatgtggacttgtttctgctgtgaaaatgcctccagatgatctgtgtcctgaaaaagatgcatctgaaaccccagctccctgtgagagcctacggcctgcataagattctttgcgtactcctgctccgcatcccatattacaaaattctttggatgcaacttgtccctccttttttcatttttaataaaacaacgtttgaaaataccgctgcgaatatgcagcatgattcttacatgatggttagttcatcgtcccaacccaagatacatccggcaccacgatccggcgcctgaatgatgacagcagctcgaacaactgctgtgtgaatcgtattataaacacagatttttaaaatgtccatacttcttttcaaataaattactttttgtgaaaacctcacaaattttgatagaataaaattccataaagcagacacacgccaggaataccaaggcttccggttgtcaaaaaggacactgcattcagccccacattcaaagcattatccccagggagcagatattgattaataaaataaatcagccccatgcccaaaatagcacggatcacaaagttcaaaacaatattcccccatttatttccttccatactcacacatcctccggatcagcatatatgatatcctattcaaatccgtgacaaaatattcccccgggccgtgcagtccgtaaaataatacgttctgcacagcccgggggataacatacggacagttctccggagcctgtctacagcttgatctttacctcgcggttggtcctatggtattggtggtaccgcacccccgcggcgtccatcatccgcttggaagccagcacaccaggagtatcggcgtatttgtcacagtcatagataacttcctttatcccggactgaatgattgcttttgcacattcattgcacggaaaaagggagacatacagcttggcccccgacaggctgccgccattgtaattcaggatggcatttaactcactgtgcgtagaatatacgtactttgtctccagtggatcatccccttctcttgcccaaggaaattcatcgtctgaacatccgatcggaaacccattgtatcccatggacaatatcttattatcctgactgacaatacagcaccccacctgtgtatttggatccttggagcgcatacccgaaagcattgccacccccataaagtattcatcccaggaaagataatcctttcttttgtcagacatatctatcctctcctttcgttcttgcacctgctatttcgttccgaaaatgcggtctcccgcatcccccagcccgggtacgatatatttatgctcattcagatggtcatccagcgcgcctatataaagatccacatccggatgttccttctgcatcctctccacaccttcaggcgctgctataatacacatgaaacggattcttttcactcctttgtccttcagcatctgaatcgctgctgtactggagccgcccgttgccagcatcggatcaacgacaaagacctccctctcatcgcagtccgccggaagcttgcagtaatactccactggttcaaaagtctccggatcacgataaagcccgatatgtccaacttttgcagcgggtatcagagagagcatcccgtccaccatcccaaggcctgcgcgcagaatcggcaccacggcaagtttcttaccggtcagttccttaccgatcatctcacagatgggtgtcttaatcttcacgtcccggagcttcaggtcccgcgtagcctcatagcacatcaggccggcaatctccccgactacctcccggaactccttggtccccacctcttccctgcggatatagctgattttgtgctgaatcaatggatgatccataatgtgtacttctgacatcattctcctcctttagtaagtgcattaagtttatatgttaatttttttattaacatcgatattatttcatagcattctccgtatgccgtcaatggttgtccataaggatttggtatttctgtatcctcctccgcgaactcatttagagtatatacattttttatgttctcatactcggatataaccttccacttttgattctcatccattgtcagaacaagcgtatcctcctgcaggtcctcctcagagaaagcaatggatgaatggccttccaggctcatctgaccgcttttcataattgcctcggctttctgattggcaggctcaggaaacagtacgataagccccctggaatctatggcgtactcctgttccagatcctggcagcgcagaagttccgctgccatggggcctctgcttgtatcggtattgcttaagaatacgatgcgtctgtatttctgctgcttcacgattgcagcggcaggcagcatcacatgcccggccgccttttccagccggttcatgatcgccttaccgatcccctgcgcggcaaaggactcactgaagattacgctgacttcctcctcatcaaattcccggagaaccgcatagagattccttgcaatggccttctcattttcccgcgatcccagattctttaccagtccataggtataaaagggcatcgtctcgtttgtcgcaataatcccggtcttttgccctttgcggtgtgcctcataggcaagctgccggatcgcaagcacttcctctctcagagtgccttccacgatcatcagcctggccctgggcgcgtaatggcggtacttcatccccggagctttgggcacctgtgtgctctcacttcccagtatggtctcatccacgctgaccgcaccgatgacttcctccagcatacccgccgtaatggcgccggggcgcagaatcatgggaggtgtcactgtcatgtccagaatggtggattccagaccgatatccacactcccgccgtccaggatcatatcgatcttaccttccagatcctctgccacatgctgtgccgtcgtgggactcggacggccggacgtatttgcgctgggcgcagacacgtaccctcccgctgcaaggatcagttcccttgcaatcaggtcgcttggcatgcgtacagcaaccgtctcaaggcccccggtcgttcccatcggcacaatattacttttttcaaaaatcattgtcaaaggccccggccagaaatgaaatgccagttcctctgtagcagcgggaatgttcaccgcgatctcatcaagtgcctgcacatctgcaatatgcacaatcagcgggttgtctgacggacgcccttttgctgcataagttctttttgctgcctcctcatccagtgcatttgctcccagtccatagactgtctccgtgggaaatgcaacaagtccgcctcttttcagtatttctcctgcttcctgtatcacgtcttcgtctatctgattcttatctactttttttattattgttttcataggcttcattataccattaatcaacctaaaaaaaaactctctttcacaaaataagatgcagtcctaattcaggcattgcaaaatccccgcgcagacggcctccgccagcgcatcctggtatgctccgtccaccagtttttccgcctcctcataattactcaaaaaaccacattctacaataatgacgggcacctctgtctttttcagcatataatatgtatcattcgcctttgcctgccttttattgtccggatcaacagccaaaagagcctcctgcataataccggcagccttctctccgcccttggaatgcgtatagtagaatacctgggcgccatgtatgctttctccttcatagctgttctgatgtatgctgaccgcgagatccggtttttccttgttaataatcgccacccgtttcttcatgtcttctgcttttgaatttgcaattccgttttcatcctcgcgtgtcatgatcaccgacactccctgtttctccaaaagtgtctttaccttgcctgcaatctccaggtttatgtccttttccagcgctttattaattcctaccttgcccggatcagagccgccgtgtccggcgtctatgacaaccattggcttatcgcccttttttgccgctgccgcagtctttttgccctcgcttcccatataattcttgtacaggtattcccctgccttctggctccctattactgcgcacaaaagcagtacgatcagtcccagtattcctattttacggcgcaaaaaaacatcccctttctcatatactattcctaagtatatgcagaaaaaggatgtttctttcatatttctgcagtgcggcgtataatcacgcgcacttatgaacatcgtaaaattcactagtacagcaggtacttattgctgaatcattagtgcaacgctgtactagttcacatattgcaggattagatcccaaatacctgaattctcccagccgagccgccactcagccactccggccagattattgcttttgatcagcttcagcttctcctcaatggactggctgtcctcaagccatattttataagttccgccatcgacatcccactgggcataattctgcttcgtcttatcatcccattcggcctgaacgcctgccgtctgtaatgtctgatttgcctcgtccatgcccatggccgtactcgtcactttgttcggatactgcgccgcctctgtgcctgcttcctcctccagttctgccgttgtcttaggagtctccagccacagccttgtgtagaatggaattgcattgacaagttttgaattcggaacgactttgagggcgttctctattccgtccttcacatagttataagatgccacagggcctgcttcataggacccctccgtgtgctcgtcataccccataatgataacataatccgccataaccgcctgttccttcaggttatagtgctcgttatacggcatggggacataattatccacggaaaatacaaggccgttctgcctgcattttacggacatctcgcgtacaaactgaatgtaatgttctccacattcagcggatataagctcaaaatccagattgatgccgtcgatgcctgactgcagcgcagctccgattacctggttgattaggttctctctctttgaggtatagcttaaaactgcataggtctcatcgtaagagcttatacctccatggaaatctctcagcacagcccacacatcaagattcgactgatgcgcatagttgacgtactcggaattagccagagacgagatattcccgtccgtgtcgcttatgttgaaccaggtcggtgcaatcgtagtcaaacccttggtattggcaattgtctccagcacatagctgttcgccgtgtcattctccacattgtgccaggccatattaatcgtataaccggtagaaatattcgtataatccggctcctggaactctctggaccgggtctcttttgtgatcttcttcagcgaacttgtcttaacataaccaatgaacccatcgctggtacggaccttcatccagtcattctcatcttccagtatccttagcttttctgactttttcacctctgtcagaatcgggctcttcacaccgccctggtatctgacctgagtgtcccttttcagaccggatacgctttgttctccccaattgcagtcaataaccgccctgtcagggttctcatatactttatattccatattggtatactgctgtataaatgcgagtgcaatatatgcagtcttaccttcggtcttcagaattacatagtcttcacttttcttttccttaatatcggtgtactctttgctgccgacgcttacagatacgctgccgttcggaagggtatagagcaggatgttctcattagaatcccagtaaaatctttcattgatataattacggaccacggaatactccacatagggtatgccatcgtaaaactttccgcctgcagaactgctctcctgcgttcctgcatcccgggcgcccatgatctggtcatccactaccaccgcaagatcatcgttattctgtatcccataatattgtttcaaatcagccttctcttttgatgagccgtattttttccagaatacgaatccgcctaatgctataataaccagaacaacgaaaagaatcatccttatgatgagattgcgtcttcttctccttgcccggctgctctttctccttggtccctggccattcggccccgtactcactggtcttgaactccccggtctctggtcactgctggctgggcgtcttctctgtgcattctgctggctgcgccttcgggcatactcagctcttttttctctttcgtccatgccgcacctcctatcagaccttattataccatatttttttcatacgtcattagtattttgtctttttacaaagtttttagacgtatgcccgtggcagcctgtattgccggctgtccggcagactgaggggattctctgcctaattgcttccattaatatttacaaaagcgagtgattctatgtatcctttgggatccagaacgtaatcccgcatatagcacccttcctcacggatcatatgcgccgtcacaatctgcagcgggctggcctgacagccgtccataagcatgttcacaccgtgcttttcataattctccagttctgtgtataaatctctgtataaatgagctgtgtcaccaatttccatggctcactcctttccctgcggattcggataaataacagccgctgcctgcttctttcataccgaaggcctcgtgacgtaccgccggactggtgcagcatggaagatagtatgaacccgcagttccctcctctttaagaatatctgatgattgcgtccctgaatgggacatgtgattttcctgaaatatattccacagctttcctgtgatcatgaaaagattcatgagtaaagatgtccggaatatatttagataggatttcctttatgatttcaaaaatccgaataaaattctgtacctcctttcgtatagacatatatttatcctggaatactatcttctgtaactgccattatagagagcgtgtccggctatttcaatgtgtttattgtttataagccgtccacatttgttgataactgaaaaatatagcgtccaaataatcctgtgacgggcatggtaccaaagtagtataaactctctataaactctttacagtttttctttacatattttttaattttgtttatactaatagtgagaagatatattttttttaaaatcccaatcgtaaggatgtgataatatgaagatcgaaaaactgaatgacaatcagattcgctgtaccctgacacacgccgacctggcagccaggcatctcaagctgagcgagctggcctacggcacggaaaaagcaaagtctttattcagagacatgatgcagcaggcgtctttcgactttggctttgaggcagaagacatccctttgatgatagaagctataccggcttctgcggactctatcgtattaatcattacaaaagtagaggacccggaggaattagacaccagattttccaagttcactccgtttggcgaggctggtatggccagcacagctgaagccttggaaaaattggaaggggcggaagaatttctaaatctgctgaataaggtaaaagaagccgcgtccgaaacaggcaatgtggcgaccgtaccggacgcgcctgcacttttcaatgttcgcctgttttctttcgacagtatggaccgggtaatccaggttgcccatcttcttgaacctgtataccatggttctaatacactgtaccatgacacggagaattcatcttatatacttgcactgactcaatcagaccattcaaataatgaattcaacaagatatgcaatatgctttccgaatatggtacgattgaaaaagcttccggcgctgcgcttgcatttctggaagagcactgcgatattatggtatctgcagatgcagtacagaatctggccgtaatctaatcagatactgtgggacggcgtgtacagtccccggagggtttttatgatataggaaattcctctggaattttctatatcataaaaaagcccctgcaggtttctattgatccctgcagggattttttatgcagaatcctccgcacatggcctttttattaaccgtttgctttcatggaagcgttaatcttttctacaagcagatcagaatcaatgccatgcaccatagcagcttcttccagagattccatctgtgctgacgggcatccaaggcagtgcattcctatctccattaaaataggtgctgcatccgggtaaatatttaataattcacctatggtggtacttttagaaatctgtcccatttctatttcctcctttattattcagtgctttttattataatcccaatttttataataatcaaccgcctaaaatgtaaaatccttataaaacaccgacacacttccgatctattttctgaattgttcgaacaattattttcaatttttgactactcaaaagtcaatcattttgctgatttttttcgacaaaaaattaaattcatcataacttaacaaaacgttcgttcttttttttataaaagtaatccaccaaaaacacatgtttttatgtggataatgtgtataacttttataaaaactagatttttccacgtttttttgagttttgagtgtggataagttgaaaactacctttcccaaagtttcgacatgtttttacatttttgtgcattttgtatatgccatccttttcacatttatcacattattcgcgttttttagatatcctgagtcaagatgtctaacaaaaaactacacttcaaatgcagttttttttgaagtgtagttttttttgtcaaatctttaaatttaatacttttatattacccttcgtattgtaatgatcggtgtgtaggtggcactgcagattccaatgccgtcggcttcattcattgcattgacgatattgccgtcacccatatataatcccacgtgcccgtcatataatacgatatctcccgggatcgcttcttctaagctgaccggtgttccgacggactccatatcccacgtcgtacgcggaaggctgactccaaaatgtgcatatacggattgtacaaacccggaacagtcagcgccttctgtcaggctcgtaccgccccatacataggggttcccgatgaactggcaggcataatcaataacggcctgtccacttgacgcctgaacctgcattgcagccgcctcctgagcttcctgctgctttgccgcctcttcagcggctattcgctcattttcttcatcttttgactccgcatagctgtactgcttctctacgcttacataatcaccgcatacccagcctgccgtaccgttgacatagaccggataccagccgtttactgcttcgccggttacctcgtactgctggccggccagaatcctcgtcagaatattggcctccgtactctgtccgtctcttacgttcagcacgtctgctgttaccgttgcatgctgctgttcgtaatttcctgcattttcctgggctgctttgcctgtatacaggcactctgcgggtacataaccttctacggagccggaccgtatccttgtccagtctccattatattcaagcacttctgccgacgaatcactgtacagcttgccgacccagtcacttgcttcatctggggcatttctaatgtaagtataatcactcacattagaaaatgccatattcaaatactcaccctcgttatttggtaccagatacaggtcgatgttttctttgacctccgactggtaacattcttttactgccgattcgattcctgcaaccggtatgaccggcgtattctcagtagaattatctgccgccctgaccgtgattgcactccccggaaccaaaatcgctcctgctaaagcagaaagaatcaatttctgcttcatacgtattgctttcatataaaacctccttgtaagtgtctttatcttttgtaggaagttctaaatgttacacaattgttaaatttgttacgttgttattatagcaaccccttagcattgtgtcaaccgtttttaccctattttcaatttacacacttcgacataagtcctaaaattctgttattttgcaatattatttttttatattcgttcattattttgtaacattttatcagccctattccttctattataatgtttaacagaatttttaggataaaggaaatcatttctatacactgctgaaaaacttttttttattttttttaaaatactgttgacatttttaggaatatgtattatattctaatcacagtaacaattactattattaatttacaaatcgaaaggaggtctatattggcagctctgaagtatagtcggcaacgtgaatccatcaagcggtatctgatgatgacgaaggatcaccccactgccgatacggtctacctgcatgtaagggaagaatttcccaacatcagcctgggtaccgtataccggaatctaaatttgctgactgatattggcgaagtgatcaagattcccacgccagacggcggtgacagatttgatggtaatgtcatgccgcacaatcattttttctgcacaagctgcagaagggttctggatctggacctggatatgaagaatatcgaagaggtcaacaaggcagctgccgagaactttgacggcatgatagaatccagcaccacaattttctacggtaaatgtggagactgcatacacaagccgtaattaggaacacagaaagttcactgaataaacacacgtgattaatataggaagtgtaatctgcttcctatattaaaaataaattaccggcaggcataaagcctccggaagcaactatacttataaaatattaaaaagaaaaggagatttttattatgaagaaatttgtatgtacagtatgtggttatgttcacgagggagacgcagcaccggctgaatgtccgatctgtaaagcgccggctgataaattcaaagagcagacaggtgaaagagaatgggctgcagagcacgttgtaggcgtagctcagggcgtcagcgaagacatcatcgctgatttaagagcaaacttcgagggagaatgctcagaagtaggtatgtaccttgcaatggcaagagttgcccacagagaaggatatccggagatcgggctgtactgggaaaaagctgcttatgaagaagcagagcacgcttctaagtttgctgaattattaggtgaagttgttaccgacagcacaaagaagaacctggagatgagagttgacgcagagaacggcgctacagctggtaagtttgaccttgctaaacgtgcaaaggctgcgaacctggatgcaatccatgacacagttcatgagatggcaagagacgaagctcgtcacggaaaagcttttgaaggcctgttaaagagatacttcggttaatcacataccctttagatacacattttactccaacattcatataagcacccaatttatacagacggggcagtcagccccgcggtaaaacgtaaatgcctgcataggaactacctctcctctgcaggtaatttactcttgccggaatgggatatttatccattttttatttttatttcattgaatcagaaaaacagcatgttataatatagatattagaaaaaacaaggaggatttactatgtcaaagtacgcaggaacaaaaacagaaaagaatcttatggaagcattttcaggtgagtcacaggcacgcaacaaatatacatactatgcatctgcagcaagaaaagccggctatgtacagatgtccaatattttcttagagacagctgaccaggaaaaagaacacgcaaaaatgtggttcaaagaattccacggaattggggatgtagaagccaatctggaagatgctgcagcaggcgagaacttcgaatggacagatatgtatgcccgcatggcaaaagaagctgaggaagaaggcttcacagaactggcatccaaattcagaggcgttgcagaagtagaggctgcacatgagaaacgttatcagagacttctcgatcatttccgcgcaggacagactttcaaagacgaagcgccgcttggctggaaatgcggaaactgcggttatatctaccagggcgacgaagctccggaagtatgcccggtatgtgcacatccacgtgcatacttcgaaagaaaagctgagaattactaaaatataaggtataatatagttgtaaatcaagtgtgcaggcccctcatgactgaggagcctgcacactttgtatgatgccgttttgcggctgtatggatgatcggggctcgtatatcctcgagagaagctggcggccacgataaattcagttttgcagcactattttccccgtcttttttgtctttttgccacaatgttaatttgctttccccctgctatactaaaattgttcataaagatctattttaggaggaaaacacaatgactgtaaaagaaagaattttagccactctgcgtggcgagcctacagatgccctgccctttgttccgcgtctggataactggttctacgctcacgaagagacaaataccttacctgatgaatataagcatgccaatctccgggaatttgcagatgacctgggcgttggatttcattctattgtccctaacttcaaaggctggcgcgaaggcggggtcaaagacctgcacgtaggcctggggatttatgatctggaactttctccctggattgtcagattccacaacgtaggaattgcccatgaacggaaagataacggtgaattaactgttacttatgatactcccaggggcattatccgaaccaaagttgtctatacaaaagaaatgctccgggaaggaattactctatatgctcataaagaacacgcattaaaggaaattgaagattatgacgcactggcttatatttttgagaatgcagaagtaattcccaattatgaagctttcaccaaatatcagtcagaatatgtaggcgaacgcggggtagcagtggcactcgctgcgatgtgggcgtctgccggacattatttaatcaaggagcttatgggatttgaagatttctatctggccagattcgatgataaagaagcaatggaccatcttgtatcccgtatgactccattctgtgacaaattatttgatgcagcaattaacagccctgccgaggttgttctgtccggagctaactatgactttaattttacaacaccggatctcatagaagactacgtggttccatccttaaaaaagcagagcgacaaagcacacagcctggataagtttgttgcaacacatactgatggggaaaatacaatgcttctcgataaatatgtccgtgccgggtttgatatagcagattcaatctgtccgaaacctttgacaaatatctccttacaggaaacccgtgatgtgtttcaagataaaattacaatttggggcggcgttccttccactgcgcttttaacagccaacacaaccgaccaggaattctatcgtattgtggatgaaaccctgcatgccattggaaagggtgatcatatgattatgtccgtagcggatacccttcccccggcagcagactttgggcgtcttctttatcttaaaaagaaatttgaagaatttggtcctgtcaccccctagagtaagtttgaaaattgcttctcataagatggcgtcctggtttgtccattccacccggaggtcctttatataataggaaaatgcagagcactttcctattataaaaacagcggaggtccttttagagactttcgctgttttttcctaaaaaccgtttctttttcgcttaaaatacgcacacatatactttaaaaattctctttcattggatttttgtaaaggatttatggagaagattacttttagcttatttaaccggaacaccagtgtattcttgtgtataaataattccttgctgctgtctaccagattataattattacgctcaagggcgtctacaagttctactatatcatcctgatttttctcatcaagcagttcctcaaacacgtgatatatctgatgcagctccataaatgggacaagggaatgtatgtattcaccggcatagtcgtagaaatatactcctctgctttttgccttcacatgatcccggagccagcagcattgttgatatgcttttctatactcttccagctcattctggaaggttccgatataaaaatggcattcgatatcacgatccagcaaaaagccaagaaagttccccagatattcccctattacatacttatatgtcccctgaagaatcttgcctttgtcaaaacatttaaatataataatttgtttttcccttgttaccgcagaaatatcttcataagtatgcagacttccctctttaattttcctcaggagctgcgaggtatccacatttccctctgttgtaatcagtatggggattctgacggcagtttccgagtacccaagctgggaggcataatatttcaaagaaaacagatctgtatcttcaccatagagtattaaattcaaaaactgctccttcagattcttacgatgttgtatatcttctttatataattcatattccagcatggtctccacagacattctcataatcttcagtataggagcaacctcatcgggctttcctgtcattccaattacgccaatcttcttatgatgataaaagatggccatattgataccatatttcactcccagataattatgctcttcatgctctgttataatctgatcatcttctccatttatgatcttatacgcaatttcgtgaaatcctccaatcctgtctttgtccttgctggcaatgataatccctttttcgttcataatatttacattatattccgtaaattcggaaatcttatcaataaaccgctcagcaagtattttatctaacatatcctctctcccttaaaaaaccaattattctatagatgtatttacatatttaacaactatctgaaccatgaacagtccgtttattatgttctctattatgaacaaaaacacgtccctgcaggaatttatcattaatccctgcagaaacgcacttataatatatactttttataactaacaaaactatcgttacacaacaccaaggccgccaaggaataccattacaaaagaggtgagcaaaggtatgataaccgtgaccataaacatatcaaaataaatctgtttgtacccatatccggacagatccagcagcaccagcacaccgccattatgcggaaggctgtcaaatgcagccgatgatactgccgcaacacgatgaaaagtctgcagtgatattcccgttgactgagataaatcaatgaacttactgctcatggcatccattgctatggttaatccaccggaggatgaccctgtcgccgctgttattacatagatagcaattgcctccgcaatcagtggattgcttatattcacagaaaagatagcatccgtaagcgctgcaaaggcgggaactgctttgattaccgcgccaaagccaacaattgcacttgtattcagtgtaggaataatcgagtttgtggcaccatcgttcagtgttttcaatggatggaggtactttagatttaataaaattcctacaatattaccgagcagcaaagccggaataatcatatttgcctttacaaagtcgcccaccggtataattgcaggcaatacattatagctgacaagtactgttacaagcggtatcagcgaaataagcggatgaggtaaatcctccgcattttctgaaggcagctctttccccggctgttcatcaaaaaacagccccttcttttcataccgtttttttgcatgtcccagccacaacatggataacccaaacatcatgactgctgcaataattcccagtacaggcgccgccatcgcagttgtgccaaaatagttggtcggaataatattctgaattgcaggagaaccgggaagtgccaccatcgtgaatgtaaaggttccggcctgtattgttgccggtattagacgcctggagatatttgcctcccgaaagatagccagtgccagcggatacaaggcaaaagaagcaacaaacatagaaactccgccataagtcagaaccgctccggcaagcacgatagaaagcaatgctttcccttttccaagcttcccgacaatgaaaagtgcaatagactttgatgcccccgagtcctccattaccttgccgaagattgcccccagcatgaacatcggcagatacgtttttgcaaatccaaccataccttccatataggttgtcatgtacgcttgaaaaaaatcaactccgctcaaaattgcaacgagtatggcgcatataggcgttgcaatataaatggaaacccccttgaacaccaaaaaaataagtagaatcaaccctaaaaaaataattgctatctccatgattttcctcctgatatttgttatacctattatatcaaggagagcagcagacgttcttgtacctagaatacaaacaattgtttcttttttagattcaaatactaaaaatcacttttaagcctttcaggatctatcccccatttccacataccagtcccctgctgccaagcagctccagcttcttcctgcgcggcagccgcttaatagcatactcccgccgcatagcctcctccttcgtctcaaaagcctcaaaataagccagcaccacaggcctgcgggcccgcgtatacttagcccccttccccgcattatggtcactcacccgcttctccaggtcattcgtccaccctgtatacaaactcccgtccctgcacctcaaaatatatgtataattcatccatcaaacacacctttccatacctatcactataccacatatccacatcctgatcaaaaaaaactccctcactgtggataactccaccaattccccacccccacctgtaattttgtggataactaaaaaaagtcctttttataaccagataaccaaagtcccacagaaccacctagaaagtctctaatctttataaatcatccttggcgctccgcatccgcctctcaccgtcggatgctcccagccatccaggcgcatggagcagccgcccgccgggaagacatctagtgttttcccgacgggcggctgctccatgcgcctggatggcgtccctcccccttaagactccataaagtccataggattcacaggagccccatctttgagcacctcgaagtaaaggttcggcccttccacgctataatattttgttggttcgctcagatatccgactgtctggcctgcatctacataatctccgacctccagcggcacttccttgagctgcccgtatactgcgctgtatccgtttcccatatccagggtgactgtggtacctgtctgggcggactgttctacatttgtaacaacgcccggtgcggatgcaccgatcatttctccaacctggccgccaataatcagtgccggattgtacttatactgttccaatgttgaaaagtataccgttttgtccatactgtagttgatcagtactgcgccgcttgccggccatgtgagcaggctctcctcgctgaaatatacttgtgcggtattccctgctgtctccgcatttcctgcggaactgtcctgcgcgctttcattctcttcggtgtcattttctgttgatgtattaccttctgcttccggcaggacaatatcattggttgtcgttgcctcgctcttttcttttgttagctgttcagtctgttcctctgctttagccagctgctggttcaattttttattataattgttgaatgtatatgctccaaccattacaatgacagcaacaaagcagatcacgattccgactgctgcgccctttccttttaataaagatggcttttcattcttattcatattcatcacctctggctatatttttgccagaaaaatgacgccttattctatttttgtaaatatttctccgccatctgtcagatttgttccctcaaaaaaattttgcagtatttcttcgcagcttttcccctcttttgccatctcgtttgccgtccactggctcatccccaggccgtgcccttttcccatagtcgtaatccgaaggcccccgtccgcctcctgcaaagagaatgcactggacgccagtgacagagcctcccggaactgttcgccgctgcagaccgtatcaccgatccgcatctgtgatacatatcccgcagaatcataggcttgtatttcaaaatcagagaaactgtaggttttttctgcattttctttatccacggccaccagaaacggctgacacttggcctgtatttccttgtactccatgttataaacatgcatctcgtcctcggcttctttatccttaggacattcttttaccgccagataggggcagtcttcatttcccagaacctcctgtccgcttcttgttttaccattgctggcctggtggaacggtaccattgcatacgtgtcattatagtataacacctgatttccggtctcatccattgccttttttaactttttgtaataagtttcaaactccttggcactccactttttttccagagatttcgtatccaggtaattgtcctccagcagcttatcctcactgctgtccaatgtctggtagaggttggtgcgaatcagaactgcctgcgctttcagcgcttcttcttcataatttccgggcatttcttttgcaagcatgcccagaaaatattcgtcccagggcaccttgattacctgatcacttccatcctccgatgttttcttcacctgcacataagcaccgccattttttccgtttacttccatatctgcgccatttacaaaaaccgcgaccacatagggaagcagaattaaaataagcaaaaatgaacagacggttttgactttttgctgcatataacgttgtcccataaaaaagccctccatatatatattatatgaagggctcaaaggggtcagaccccttttttataagtcactattttctttcttttctgtgtactcctcgtaagtctgggtaccctgtggcggcttctgcgtttctacgtcagtctctggcccggataccttttcttctgttttggattccgtatccggcagaataattactgacggctccggctcctcctctgaaacaggagactttggttctgataccggtgcttcaggcgtcacagaaggtactggaggaacgggaggtacaggcggcgtactcatatccggtgttgtgggaggcgctgtggtttccggtgctgcaggttcttcctgcactgcctcctggggcgcaggtactgcggtatatggccccggcatagatccggccggcggcatagttgggtaacccggctggataaacggtcgtcccagatctggctccattcccggattaaagttcctgttgcgcattgcgaagaggcagatggactcgtaaagaggaaccaccatgcacagtactgcgtgagcaatggacatgtttttggaagtaaacttctcaagaatctggtgatttacaagaacgctcagtactttatagaaggcactgtacacgatagcagcaatcacccagataattgctatgatgataattcccatgatcataccactgctgatatgtgaggatgtaccgcccccatggctgtataaagcactggaatagaggctggaaaacgctcccagtccgactatccatacgatcatataaaaaataaagttaaccacaccgaagataaacggcattgcaaggagccagatccccggatttttgatggttttggatttgagggtaatgcttccgcccagctctccatggagatatgtcctggcaaacggaataaacgcgagccaaggatactccatcccctgtctctttgcaatggtatacataccgattcctttgaatatataactgattacgtagaaaatgaaccatactgcaagcacgatcagataaatggccagaatcccagtaagcatagaatccaccggtgagttataagtataagtgtagctgtcataataatccataaatgcctcctattccggctgtcctgacggaacatccactttttcgagtttccagatatcctttacatactcctcaattgtccggtctgaggtgaacttcccgctgcatgcagtattcatcattgccattttcgaccatctctgtacgtcacggtaggcagcctccacttttttctgcgcctctgcgtacgcgcggaaatccttcagaataaagtaagtatcgggcctgtttgtgcaatgtgtatttaaaagggagttgtacaggttcttgtacatctcgtggttgccgcccgcataggtgccgtccatcagctggtctactacacgtttgagctcccagtcattaaagtaaatgtcaatcggattatagccgccgtttttctcgtagttaataacctcctcggaagttaacccgaagataaatgcattctccgctccgacttcctccacgatctccacattggcaccgtccattgttcccagggtcggtgcgccgttgagcatgaacttcatatttccggtgccggatgcctccttggacgcggtcgagatctgctcgctcacatccgctgccgcaaacagaagctccgcattggatacgcggtaatcttcgataaatacaactttcagcttgccattgatgcttctgtcattgttcaccacatccgctacggagttgatcagcttgattgtctctttggctctgagataacctgccgcggcctttgctccaaagataaatgtccttggataaaatgacatctccggatgctccttgatctgattgtacagatacataatgtgcagaatattcagcagctgacgcttgtattcgtgaagtctcttcacctgcacatcaaagatcgaggtaggatccacatcgattccattattttctttgatatattttgcaaggcgtactttgttctgatacttgatctgcataaattcttttcttgcgcgctcatcattcaccagcggcttcaggttgccgatcaaagataaatccgtgatccatccgtccccaatcctttccgtgatccaatccgcaagaagcgggttaccatggaggagaaaacgtctctgtgtgatcccgtttgttttattattaaacttctccggcatcatgtcatagaaatccttcagttcctgatttttcaggatctccgtgtgcagccttgccacaccgttaacggagaaaccggctataatcgccatatgcgccatgcgcacctgattgtccctgaggattgccacttttctgaccttctcctcattgcccggatatttggcgcggacctcctgcaggaaacggcggtcgatctcctggacgatctggtaaatacgcggaagcagcttagaaaacagatcgatcggccatttttccagcgcctctgccataatcgtatggttggtataggcacaggtctttgtggtcacttcccatgcttcctcccaggtcaggccttccacatcaatgagcagcctcatcagctccggaacagcaaccgtcggatgcgtatcattcatctggattgccaccttctcataaagctttttgatgtcgtcgtggtcctttttatacttcgcaatcagggcctgcaggctggctgagataaagaaatactgctgtttcagcctcagctccttgccggcatagtggttatcgttgggatagagcacatccacgatcatcttggcaaggttctcctgctcgaccgccttatggtagtcccctctgtcaaatgattccagggaaaagttcgtaatcggctctgcatcccatatccgcagtgtatttaccacatggttcccatagccgacgatcggcatatcatagggtatcgcgcgtacagattcatagttctcctgaataaacttatctctgccggtctccggatccttttcaaaacggatcgtaccgccgaagcgcacctcttttgcgtactcttgtctgcgcagctcgaaaggattgccttccttaagccagtcatcgggtgtctctatctggtagccgttctcaatcttctgcttaaacatcccataacggtagcggataccgcatccgtatgcagggtagttcaatgttgccagtgaatccaggaagcatgcggccagacgtcccagacctccgtttccaagcgccgcatccggctcctgatcctcaatcacgttcagatcgatattcatctcctttagcgcttccctcacgtccccgtacgcagtcatattaatcaggttattgcccagggcgcggcccatcagaaattccatggacatgtaatataccgtcttagcatcctgtttcctgtactccgcctgcgttgccagccagtcatcaatgatgatatctttcacggcataggacaccgcctggaatatctgctgcggcgtcgcctcctctatcttcttccggtacaatgttttcacattgtcccggacaatttctttgaaaacttctttttcaaatcgcttactatacatataacttacatcccttctttcattacgcccattgtaacagcctcgccgtttatcttccatttcttcacatagcctgccggttctgccttcacaacttcgtttgcgagtacttcgcttccgatctctttcccgtgctttgcaaagacaccttctgcttttgcgcttcccgcgtaagtcactttgatcttatccatgacttcaaagtctgcttccttacgcatcgtctggatcttgctgataatctctctaacaaaaccttcctctaacagttcttctgacaggttcgtatccagaacaacggtaataccgttatcattttcagacacataaccctccatctgcgccgtgtcaatcagcaggtcttccttaaacagagtaatctcctggccgctgatatccagctttaatgctcccgtctcattaatctcgtccatagcagcattgccgtcgagactgtccagagcagacttgattccacctaacatcttaccatactttggcccgactgtctttaactgtggtttaaaactatatgaagtaaagtctctcacatcctctgtaaacttcatattctttacattcagctcatcttcaacgatttcctgataaaattccggaagatcaaaccctgccttcacaaacatctggccgattggctgacggttcttgatattagcagtattgcggcacgcgcgtcccattacaaccagcttcaggacattcgccatattggattccagctccccatcgatataagtctcgttgacaaccgggaaatcacagagatggatactctccaaggccccactgtcaatgctgcataccaggttctgatagatctcttctgtcataaacggaatcatcggcgccgccacctttgcaacggtcacgagcgcagtgtacagcgtcatatacgcattgatcttatcctgctccataccctttgcccagaaacgttccctgcttcttctgacataccagttgctcatgtcatccacaaagtcctgcagcgcccttgcgctctccggtatcctgtaattttcaaggttctcatccactgtctttatcagtgtattcagtttggacagcagccatttatccataacactcagtttttcataatccaggctgtatttcgttgcatcaaattcatctatatttgcatacaatacaaaaaatgcataggtattccacagcgttcccataaacttacgctgtccctctgtcactgcttttccgtggaagcggttcggcagccacggtgcgctgttcacatagaagtaccagcggattgcatccgcgccatactgattcagcgcatcaaacggatccacagcatttcccttggacttgctcatcttctggccattctcatcctgcacatggccgagcacgatgacattcttgtatggcgacttattaaagagcagagtagagattgccagcagagaatagaaccatcctctcgtctggtccacagcctctgatataaagtctgccgggaactgctgttcaaacagttctttattttcaaacggatagtggtgctgtgcaaacggcatggaaccgctgtcaaaccagcagtcaatcacctccggcacgcggtgcatctctttgccgcagaccgggcattttatcgtaacatcatcaatatacgggcggtgaagctcgatatcatccggacagttatcggacatggacttcagttcttcaatacttccgatggagtgctgatgtccgcactcacactcccagatattcagaggcgtgccccagtaacggttgcggctgatcccccaatcctgcacattctccagccagtcgccgaaacgtcccttcccgatgctctcagggatccagttgatcgtattgttattggcaatcagatcgtccttcacggcagtcatattgatgaaccaggattcgcgcgcgtaatagatcagcggcgtatcgcatctccaacagtgcggatagctgtgctcgaacttcggagcatcaaagagaagccctctctcctccaggtctttaagcaccatcggatccgctttctttacgaagacttcggcaaatggcgtggactccgccatattacccttttcatctacaagctgtacaaacggcagtccataacttctcccaacattcgcatcgtcctcaccaaaggcaggggcaatgtgtacaataccggtaccatccgtcagtgtaacgtaggaatcacaagtcacatagaacgccttcttattctgtttcgcagccccctccgccgcacaggcaaacagaggctcatattccttgtattccagatcctttcctttatatgtctccagaatctcatatgccggcttatcctcttctgccagcttgccaagtaccgtatccagcagtgcctgtgccatataatacacatagccgtctgctgcttttaccttcacataatcctccaccgggttcacgcagagagccagattagaaggcagtgtccaaggcgtagttgtccatgccagaatataagcatcctcatccttcaccttaaatctgacaatcgcagatcgctccttgacatccttatatccctgtgccacttcctgggcagacagaggagtcccgcaccgcgggcagtaaggtacaatcttaaatcccttataaagaaggcccttgtcccagatctgtttcagcccccaccactcggattcgataaaattattatcataggtcacatagggatgttccatatcagcccaaaacccaaccgtactggagaaatcttcccacattcccttatatttccaaacactctctttacacttatcgataaaaggctccaggccatattcctcaatctgatccttcccgtcgagtcccagaagcttttccacctccagctcaaccggaagcccatgcgtatcccatccggctttacgcgggaccatataccccttcattgtgcggtatctcggaatcatatccttgataacgcgcgtcagcacatgtccgatatgaggcttcccgttagcggtcggaggcccgtcatagaatgtatactcagggcagccttccctctcctccatacttttccggaaaatattattatcagcccaaaacttttcaacttctttttcacgctcaacaaaattcatatccgtagaaactttcttatacataactcatctctttcctttctattaaaatgaatccttatacacacaaagcggtttttcccgctttagctcctcacccatgaggggcttgcacactttggcgccgccgcggtgccgctttgcggctatataccttatcgcggcgtgtgcatcctcccggagggtttttatgatatgggaaattcctttggaatttcccatatcataaaaaagcttccgccctgtaataggacgaaagctttaactatcgttttaccacctgttacaacatactcggactgcctgttcctgccctgtatatgcgttcccgtaacggaggaactccgtcagcctctactgcttacgtttcgaggactgcgactcagaagtgatgttcagaaacaccttactcataccggactcccaccgcctccggctcgctgcaaatttcagataaatcctactgtcttcgtcattgtctttcctgttttgtctgcacagggatattataagaagaaaccagcgaatagtcaagggattgcacacaaatttcaccaaattccatagccccccctcttcatccccccataccaaacctcgtaatccaagccccatttctataagtgaattaccggatatttgttgaacttaatgttatgcataatgtataatgaaaccatacgtttattcgaagggcgaaaccgcccctgcagatcgatattccacccgtataagttccatattcaaaactacaaaggagatttgttatatgagaagaaagcctgaccttcacattcgattttttaacgattttgcagtatccagcccctattatgagtacgctccgagcgcacacaacagtacacagttgacattgttgatatcctacctggttgccaatcaggataccaaagtgccaaaagacgtactgatggccatgctgtggcccgacgaaaaggataagtgtccggtcggcgccctgcgcaatctggtatacagagcccgtaaagagctcgaacatctttatcccgataaggatgtggattacatcaagtttacccaggatgcctactactggaatccagatctttactgtaagatcgacatccatgactttgagaattacaacaacctggcccggcaggaacctgatccggaaaggcagttccgttattactaccggatgcaccgcctttataccggtgaatttctttccaaccacacctccatcgaatgggttcagtaccgcataacctattataagaatatgtatatcaactgtaccatgaatatgtgtgaatatctctataccaggcgccgttatgatgaattgattgctttatgtgaccagtctattattttctatcccgacgaagaccgtttttaccgttataaactgcttgcttatctgggtatgaatacaattaagacagcactggaatactaccacactaccctggattttttttcttccaaatacggtactgatatcagcggatctctgagggatgtccatcaggagattctcctgcgcatgcccagcaaagagcttgatatcaacgaactggagacaacgcttggaaaagatgataagagcggacagactttttactgcaattttgatatcttcaagaacatctatcatctgcattcccgctcctccctgcgtatgccgggacggcattatctgatgctgcttactctgcattcaaagaaggaaaagatgccggatgccgcaaaggtaaaagaagtcatggaaaccctgtactatatgctttccacacatttgcgtaaaaatgacgtcttcaccaggacatcgctgactcagtactctgtgctcctgtgcgtaacagaaaaaataggcgtggatacggtagctgaccgaataaacgaggcgttccatgagatgaatccaaattcggaattgtatctggaagtctcgagcaaggaaatctaaaaaccggagcaaagcgggtaagccccggaggcatttcctatatcgtaaaacagcaccgcagcagaagaggcagactgtaccggggatgcatacttattgcacgatccccggtacagcccgcctctcctgctgcggtgctgttataatctctttcttcttattgtatatatccagaactgtcacattattatagaattctgtgacttcatggaacctgccttttactgaaagcgcctatttgcgtgaatcattcactgccttatacattgccagtatatttactcccggtacatcaggcatgatgttgtgttcctgattgaatacaaatccccctcccggagcaaagatatcaatcattcttcttgtgtaatcataaacctcttccggcgtggatctgttcaggatgcttcttgtattgcatccgccgccccagaatgttatatcgtttccaaattcgcgctttaatgttgcgggatccatctgatatgcagttgtctgaaccggattgatcacatcatatcctgcgtcaatcagatctcccataatcggataaatagagccgcaggagtgcaggaatgtcttcatattactgtgtttatgcacatattcattcaactgtttatgatatggtttgaataactcctgatatttttctctggacataaacatcccggtgtccattccaagatcatctccaaaacggaggatgtctacaatatctcccacagattcacataccttttccaaagtagccagatgacggatcatcagctgttccaccagtgattccacattttccgggtctgcatatgtatccatcaggaagttgtcaattcttctcagaaaggttccccactcgaacaggttgcatccgcaggtaatcatcaacgcacggtctgttttctctctcagggccagtgtccgctctctcagtttctgataaaaatgatcttcgccggcatgatcccaggggctgtgcaccaatgcgctccagagcacttttcccatctgatggtccagatctgaccagtcatccggataatcatctatataagggaaatacgtctggtcaaagaaagttgcgcccaccggcattcttgcgatcagagttccttctgcgtcatgaacaacatagtctccgttttccagctttttcggctgaaaccatttgggatactgaccggtagaaccatccgccagtgttacatcgtaccagtcatcatcgttctcattaaacacccttccgatatcaatcacatctacaccgaacttatccataagttcaagctcaggctgtactacctgctgaacaacgtcgtatattcttgtatgcccgcctgtaatacccatctccttcttcaggttgttgtaagcaattgctgagattcctgaacttggagtcccgcccagatccagcggcacataatcgggttctttgtggttgattgctgccaatactctttcccttgacatcatcatatttattcctccaattctaaacgattagatttttttgtatgcgataattaatttgttacttatgattataactgaaagagttttaaattcaacatggtttttaatatttttatctaaacgtttagattctttgatttttctaaaataatatgctatgatgaagcaacagaattatgcagtgctgattttacaaaataccggaggtgactgtcattggcaaccttaaaagatgtcgcaagagacgcaggagtttctattgcgacggtatcctgctgcctgagcggcgcaaggaatgtaaagccggagacccgtgccagaatcatggattccatagagaagctgaaatatatcccaaatgcatctgcacgcaacctcaagaccgcggattcaaaaaaaatagggattgtgctgacagatattgatgattattaccatgccgaaattttcaaaggcatttcatcctatcttcagaataaggggttcagcatgaatgtagccttttccaataactcccctgatatcgaatgcgataagatcgatgattttgtaagcggaaatgtatccgggctgctgattattacatcacagccacagaataccgaatttttcaccgccagaatcagaaattataacatccccgccgtatttatagagcgcaggcccgataatctgaataccagttttgtcagctttgacaattctaaaaccacctattatttaacagaaaatcttataaaaaaggggtatcagaatattgccctgatcacgggatcacagcagttttcctcggaggccgaggccataaaaggctaccagcttgctctgcaggattatgaacttcctgttaatccggatctgatccaaaccaccaatctgaccagggaggatgggttcaaagcatttctcaccctccccctcctggatcagatagacgccgtaatcaccacctctgaaaatatagcccagggcgtggcagaagcctgcaaaatacagggcagcatcccctccgatgacatacagatcctgacctttggagaagagtcctggaaccgcgttaatctgtccggaatcatccacacctcgcgcaccgcattcacgctgggcacaaaagccgcgcagctgctcatgcaaaacattgaatcgcctgtcctgtttgaggaaaaaactctgattttcacggatgaaatcatacacagcaggcttcctctgcccgaagccaaaaaaaagacccctgcctccaaaaaggcgggctcttcaaaggaaccgctgcgtatcctgatggcagacctcgcaacctcccatgccgccaggctgctttccgaaaactttacacggcagacaggaaatcctgtggagatcgattttgccgcccagaatgaactgcctggcaaaattgtggaagatctgggccgctcccggtcccactacgatatttatatgtatgatatcccctggctgcagtatctggttcaaaacggactgattgcagacatcactgatttcatagaaagcgacagcttcaactcggatgcctttttcccggaaaatctgaacaactgtatgttcgataagcgttattacggcatcccgatcgtcggcggttcacagatattattttacagacaggatcttttcgaaaacaggcgcatacaaaaggattttaaaaagatgtttcagattccgctctccccgccccgtacatggacagagttcaacgggatcgcctcctttttcacaagagactgcaatccggattctcccacccaatacggtacctctatggccggaatcgtagatgaagaactggctcccgagatcctgatccggctctggtcaggcggcggaaaactctgggacaaatacaaccgggtctgcatgaataccccggagaacgcccaggccttcggcagtatcctgaaaactctcaattatatagaaaccttcccgttcgaaaccgatatatccaaaacggtccatgatttctgttcgggaaagaccgcaatgctgatcacctactcggaatatgccggccagatctgccagagcatccataacaacatcatcggacgcgtgggatacgaatccatccccggaaagaccccggccagcgtcggctggaatctgggcatgaatccctgcaccgcccgttacgaggaagcctgcctgtacttccagtggctcagcaaaaaagatatcagcatttacatgaccatcctggacggccagtcccccgcccgcgcgccatactccagccacgaactcctgaagctgtatccctggctggaactgaccgaaaagagcttcgaatactgccggaaaagaaccgggccatacagcaaaaactccctcatcatcccccagagccgtatagaaacaaccctctgcactgtactgaggcgtatcgtaaccgatgggctgggcatagcggaggcacttgatgagggacagaaagaaatgcaggcattattcaaatcctacggctatccaaaaccgctgcatttactgccctgaaggattcgtcgatctgacgaatccttttacattggatgattacaatccatagcacaccgccgggcttttacggcaggtgacggaagtgaaaaaggagagtctaggcatcaaatgtaaaatggtattcctcgaataacttattaatcttatccttaacgggaacttttaattccttttccagacaatctgtcattttttttgcaatgttttttgcctggaatacagcgtgggaggctaaaagcatatctatatattcgaaatatatatcttccatataaggctctattgccagaatcttttcgtagtaatcctggccctttaaataatcttttttatctttgaaaaaattagcaatatgtttgagcgtatgtatgtatttcacatttattttttccctctctatttctaagaaaggttcatatggatattcttcaaaaaaatctcccttatataaaagatcaagcttattcagtaaactttcatcaatcacgtctttcctattcataatacagttgcaaacatcgtcaaactcatcaatatccagggaaattccattggaactaagctgataacattctttcgtacgcaggatgtactttgagtttttcccggatttaagatctggttccagtgctttgcggagaacagaaagcgccacattaaaatggttggcattatcatacatgattccgggaaaaacagcgtctataatgatatccttattgattttgtgcttcctgttcacgatgagaaactgaagtatgcgaaggcttgaatttcttttaatatttatatctttgccgttcaatacaatgtgaaagcttccaagggtgcttatttttagatcttcctggtctgaaggctccatgaaatctgaatcactgccttccgcggaaatatccataacccactcgtatttgtatttgcggcatatttcagagagctcctgcttttttgagcggatccgatctgcctcatccatcagagtataaagctccagctgctttttcacaatactgtaatgaagataaccacatttcagacagctttcatatgcgatattcaaactccattcggcctggcggaatttcccgctctgtaaatatgcgttgcctaatgtcagatatgaaagcgctatatcatatccatcgctgtactctatcacagaatcgattgatttttttgcccagataatagccgcatcatactcttttttttcagtaagcaaagtacttttgtccgtcaaaagccaaaatgaagtaaatggctcttcttcagctaagccaaaggcctgtgaaagataaaactcagcttgtccgtagtctttaagagctatatataatcgagttagcacttccagggtatgtacctgcataattacgatgtggtgtctttcagaaataaataaggcctgcctcgcatattcaaggcttttttcgtatgatcccatacatatatggcactccgcaattaattggagattgcaggcaatcagggcatagtcattaaattccgttgcgttctgatacgacttttcaaacatttcttttgcttcggatattctgcccgtatgataataaaatgtccccagtctgttttgcagattagataataaaaaaatattctggttcatctccgccgtatgaatagcatcattcaatggatcaataaactcaataagaattgattccggaatacatcttgctaaaaacagcgaggtattcgaaaaaagcaatttcggtgatatttcctctaaatggccgtcaattacgtttataaactgcatcgcattgtatctgtgcccgatgagttttattattttcgttgctgatttatagtcattgctggcaactgcatgcgcgaaagccagtatgtaggaatggcgctgcatatagatttccgtcagcttattgtgctgctgcgacattttgcctgcattaaaatgataatagcgttcgtataaaaattgtctgaaaagtttatggtatctgactgcaccgtactcgtttttatatacaaatgcatgattatcaaggaggtatctgatgatctcttctcctctgttgatttcaagaaaatgatctactatatctggttcaagctctgtcattaaactggttttcaacatgaagtcctttatttcttccgtttcacactcaaatacttcattgctgagataatcaaaaatatcaggaacgtttgataaaagatgaaaatcaaggcggtttctttttgggttcgggaatttttgaatatattcaaggatgagttgataacttgcaggccagccttgtgttatctcatagatccaatccagctcataaggtttcagattcagattgttataattattaaaataatcctctgtttcccgtcttgaaaaagccagatcatcggcatccagttcatagtagcgtttttttgatttcaaaagcggcagtgaaaagtcaggccgctgtttccccatgataacaatcgtgacgagaggattcgcagcttctattacccttgctataaatttatgaatatccgattgtgcactcgtcatatgataattgtcaaacacgataaacaacggagctgtaagagcgttcagtttacttattatactgtcaatttcatcttcagcagacagctctttcggactataaggagtatcggattcttccggtaagagctccagcacttcctttcttatattcgaaagcagatgggcatcgtatctgataatgctgtcaataccacaccagatattatttatattgtagtgtaataaataactatacatcaaaactgttttgccaaatccgctgttggcaaatattcctataagcgacacatttctgtgtgattccagcttattgtaaagactctcccttaaatatccggatgccgcatctgatgattctgcagtgtttttgtcatctgtttgtaatgacttcattttatccctccctgaacaataacatttgttaaaaagtaatacattaaaggttttaaggagccgcttatttcgtgtatttatatgtaagtatacttacacgaatataaaattacaaggaactccggcagatttgtaagtaaaagaaaaaaagctgtaagtaagcagtaacgcaaagtggatattatcagggcagccccaaaagcgaagcgaatgcctgacgtttatttaagggaggtgagccaggtaagctatgaattgagcaaaacaggcattgaaagctgcagggaatgttatgaacaaaaagacagaatagtggaaagagggcacacaaatggaacaaagttataatccgtatgataatgtattaaaagttgtcgagcaggccgcaggaatactggggtataaacaaagtgaatatgaggccattaaatttccggaaagagaattaaaggtttctattcccgttgagatggacgatggaagcgtccatgtgtttgagggatttcgtattcaacattctacttcccgtggtccggcaaaaggcggcattcgttttcatccctgtgttaacaatgatgaagtaaaagcactcgcagcctggatgacatttaaatgtgcagtggtcaatattccttatggcggaggaaagggaggggttatttgtaaccccttgcaattatctgagagagaactgcgtgcacttaccagaagatttacagcagctatcgcacccttaatcggtccggatcaggatattcccgcaccggatgtgggaagtaacgcggctgtcatgggctggatgatggatacctacagtatgctaaagggacattgtgtacatggcgtcgtaacaggaaaacccatagaacttggcggtgcattgggaagaaatgaagccactggacgcggagtgatgtttacgacaaaaaacatcctgaataaactgaacattcctgtgaaaggaacaactgtggcagtccaggggatgggaaatgtaggcagcgttacagcaagacttctgcaggaggaaggtatgaaggttgtagcggttagtgatgtatcctgcgctctgtataataaaaatggattggatatagcagccattttggattatttatcacgggatcgtaaaaatctgcttaaagatttagatcttaaggacacagcagtaatgacaaatgaagaattgctgaccctggatgtaaaagttttgataccggcagctcttgagaatcaaattaatgagaacaatgtggatcgaattaaggcagatgttatcgtagaagcagccaatggccccgtatccccggaggcagatgaggttctggctgaaaaaggaattgtacttgtaccggatatccttgccaacgccggcggcgttgttgtttcctattttgaatgggtgcagaatattcagtctgttaactggaccgaaactgaagtaaatgaaaagcttaaaaatatcatggatcctgcattcgatgcagtctggaacattgctcaggaaaaccatactactttgcgtaccggtgcatatcttatcgccatcagacgtgttgtagaagcgaaaaagtcaagggctatatggccataatcaatacacataactatgtgaaaggagaattgaaatggattacacattttatcagggagtaaaagtgattcccggcataggatcggtcaataaaattggcgagctgtgcagggatacaggctgtaaaaaagcttttatagtttgtgatcagggtataaaacaatctggtatagcagacagaatagaaaaactgctggagaaatctgcaattgaatattacgaatatgcaaaagtggtatctgatccgccagcctctgtcatagacgaaggggcacaaatctgcagggagaataactgtgattgtgtaatagcagtgggtggcggaagtgctcttgattctgccaaagggattaacattctgcggtttaatccaggcagaatattagactatgcagcaaagccgatgcaggtatgccgcggtttaattactattcccacgacttccgggaccggttctgaattatctaatggagcgattatctctgatacggaacataatttaaaacttccaatattgtgcgcaaattgtatgagtgaatatacaattctggacccggaacttacccggggaatgcccgcctccttaaccatgatgacgggattagatgtgttttcacatgcttttgaagcttatacggctataacagcaaatatgatgacggatttagtttgtgaaaaaattatggaaacagtgattgaatacctgccacaggttatcaaagacgggaataatcttgccgcaagagaaaaaatgcaggcagcctcctcaatgggaggatggatgttatacaattgctgtgcccacgtgggacacagtatcgctcacgttctcggtgcacatttccatttggctcatggcgcctgctgttcatatggccttagtaatgttattgtagaaatggcagatacacagtgtgaaaagattaaaaaaacaggccggctatttggtttgacatttgatgatgatatcagtagtattgagatcgcgtcaatggttgcaaataaatataaagagtttgcttctgaattaggtttaaaacctgttgaagactgtcaattacaaacagatactcttgatgaactggtgaatgaagtggtaaatgagccatttgcaggattagcaccgtttaaagtcacacatgatgtggcggaacgtttattaaggtcaacattaaaattgtaagtaaaataagaaaatgtgtaagaaagcagtaacatagaaaatgtatgattaacttaaccaaaaaactgagcgaaagccagatgttaatttaaggaggagaattatcaaatgaagaaaaagaatgattgcccaaagagcagagcgatgacagaagagtttttggattacttcccggtagcacactcaaatatgaggattaaagtaagtgcacaaaattacagaatgtttattgatcatggagaaggaagccgtctctatgatattgacggaaatgaatatattgactattgcatttcttacggacctgctgcattgggttccaaacacgaagaactctcaaaagcactgattgatttgatcgagacaaggcctactgcaagctttttcttttctgatgacgatgtgaagcttggcgaacttatcagaaaatatgttccgtgtgcagataaaatcaaaatgcagatgacaggtacagaagcagtgcagacagcaattcgaattgccagggcatatacagggaaaccaatgatcctgaaatttgcagaatgtttccatggctggattgataatgtgtttggcggcggatatgacccaagtccgagtggattgcctttaatgtcattaagagaagatgatcactcttattgccctgggttaagtaaaatcgcaacacaggagacgttagtaattccttttaatgactttgacattcttgaagaaacgttcaaaaattatggacatatgattgcaatctgccattttgaggcggttccgattaaccatttctctcttcagccaaagcctggttttttagagaaaatcagggaattgtgtacaaagtataatgtagtaatgagtatggacgaagtgctcacaggattcagagtcggaccgggaggcgcacaggggctttttggagttaaacctgacattgcaaccttcggtaagatgtttgccggcggcgtagcatctgcatttgtatgtggcgtagaggaagttatgagagtgcttccggagaagaatgttctttctgccggtacatttaatggctggcctttggctcaaagggcagcggcaactacgatcgacatcctgaccagaaatgatggagaggcttacaggaacatgtatgaaaaacaggaaaagattatggatggacttgtatgccttgcagataaatatggattgaagctgaggattacagagaatcccggttgcttctatactatttttggagtagaaggcggcagaacacctatttattcagatgatgatatcaaggatatggacgatgatcagaacaataccttccgtaaattaatggagaacaacggggtgctcatcttacctgcaaaccgttggttaatgagttttgttgtaacagatgaagatgttcagtggacattggaagctgcagaagatgtaatgaagcaaatggccaaataaacaatctcattcgaggactttacgaggaggaggaaatgaagaaatgaggaaattagataagtatgatattgattttagatcaactaccggaaaaatcccatgggtagataaaatcgcaatgtccttaaacagcggatttgcattcaatgttgcctggataatattcggatattacctgatgttcttttatacagatattgtaggaatgagtgcaggtgtagccggaaccatcattttagcagcacggcttctggatgttataacagacccgatcataggatatttaatagataatgtctgcctgaaatggggaagattccgttcatggatgtttgttggtattcttccgcttacgatatcatttgtagcaatatttacaaatttaaagggcgccacaatgggcacaaagcttgtatgggcagcaatcagctacagtatatttggagcaataggcgcaacagcaacctattcgccctttaccggcatggtaatgaatatgaccaaaaacccacaggagagagcagtgattgcaagcctgcagggtatgtttaatggtatatcaaatattgttgctgctaccttcttcatctcgctggttaagctatttggtcataattcggccgatcagtccaaaggatactttggagcagctatcgtaatcgcggcaatcatatttatttgcgcattatttgtaattataatcagtaaaaaatatgaattaaacagagatggatctgtaagagaacatcttatgcagacagaacatgaaccgtttttaagccagctgaaaaatctggcggcaaacagacccgtaattattcttattacaggacaaattatatttcagatcatgctggctataaggaacggcgtaatgatttactttttccagtattactggggaatggaagatttttatgtcacagcggtattctggaatacagtagcattgggcgtgggggcgttgttacttaagccgcttatcaaatgctttggcgatactaacagagcctataaagtagtgatagcagtaaacatcgtgttatttgcagttatgttttttatggttcgggctatgggtgcagaaggcagtggcgaatcaatacaatttggactgctgttcgctgtgtttcttttcagtggtctggcgattggttcttatacttcatttgcaactgttttaacacttaataccgtagaccacagcgaatacatagctggaaaaccacaggccggactgatccatgcgggcttcggactgtcaattacgcttggagcagctttaggaggattcttcttcggaaatatattagaagccatcggatatgtggccaatgcaaaacagagtgcaggcacattgaattcaatgctgtttgtaatgttcgcagtacctgctcttcttacgttagcacattttgtattgcagcagtttttcaatcttaccgacaaacaggttgctgaagaactccaggaaatgaaatccaaaaaaagcgaagcataaaaatctgaataattgtattggttactgtgctaacccgaagagtgtgaacagtaatcaatacagttatgaaaggagatcaatatgaatgtatacaatacaatagacatgatgtatgaggtatgtgatgaagcaatttcatcaaaagacctgttatgcaaattagacagctttgtaggtgatggagaccatggctttactgtagcccgtggattctctgctgttaagaatgtacttgataaaggaagcttcaacactcccagagaagtatttgcagcggttggagatacactggcagaatctatgggcggcgccatagggctcattataggcggactgttctcgggcggcgccagaacaatgaatgacagcgctgatataacagtggatgacatatataagttactcagaaatggcctggaagaaatcaaaatgattggaggggcaaaagaaggggacagaacactgatcgatgccctttctcctgcatgtgatgcctataaaaataaaatggattctgaatcaggcttggccgaatgccttcatgctgcagcaattgccgcgggtgatggtgctgcaggtacttccaaaatggttgccagaaaagggcgggcaaaatttttaaataaagagtctcttggctatgtagatgccggttctgtaacaatgcaaaaagtgatcgaagcaatgtggaagtatgtgcgtaaaatagaggagtaaaataatatgaaaaaatttttaaataaaccggaggatattatgcaggaaacggtagaaggctacgttttagcaaataaaaaccgcctgaagctgacccctgggacacataatattacaagaaaggatccaaaagaaccgggtaaagtaaaagtggtaattggtaacggaggcggtcacgaaccgggaacaatgggacaggttggatatggggcctatgatctggtttccttaggcgaggtgttcgcagcccaatcaggaaagaagtttttcgaagcaatcgaggatattgatgatggaagccccattctgctgacgattgccaaccatgccggagatgtaatgaacgggaatatggcatatcgtctagcgaaagaaaaaggaatggatatagagaaagtaattcattatgatgatgtttcttctgcaccgaaaggctatgaagaggaaagaagaggcacaagcgggttcttcttccctgttaaggcagcaggcgcagttgcagaagaaggcggaacattagaagaatgcgtaaaagcttttcacaaaaccagagataatacaagaaccatttctatagccctgagcggatgcacacatcctcaaactggcatgcagatgatgagtataccggacaatgaagtaagtattggagcaggagctcacggagaagggggctcctatagcggtaacttcacaaactcatatgaaatgctaaagatcgcagcagattatttgattgaggatttgccatacaaggaaggggacgaggttttattgctcgtaaatggtatgggatccacaacaatgatggaattgtctattgtatacagggatctgtgcaattatttgggaacccatggaataagtgtctattcaggggtggctgcaaacatggtaactactcaggaatcatcaggggtttctatttctttctgtaaagttgatgacgatataaagaaatggtgggacgcaccttgcagtacaccggtctattcaaattaaggaggatgtactgtgttaatatcaatgaagcgtattttagattatgcagaggcaaatggaaccgcaattggtgcctttgatgtagccaacctggagggaatccgtgctgctatagctgcggcagaagagcttcatcagccggtaatcatacagtttgcacaagcgcatcatgcgataagccctgtggatatattggggccaattatggtaatgatggcagaaaaagcagacgtacctgtatgtgtgcatctggatcatggtgaagaactggagtttttgaagaaggtacttgatatgggctttacatccgttatgtatgatgggtcagctcttaattttgaaaaaaatgtggcaaatacctgtatagccgtagagctggcgtccgcatatcatgcatccgttgaagcggaaatcggttccatgggaagagaagaattcggcagtgccggggcggaaggaaaggcaatcgaaaatgtgtacacgaacccggcagaagcaaaagaatttgtaaaacgtacgggaattgatgcactggcatgttcttttggaactgttcatgggttatatctgacaaagcctgtattggattttgaacttatcagcacaattcgcaaagaagcaaatgtcccggttgttatgcatggcggctcaggtctgcacgaatcagaatataaagaatgtatcaggcgtggcgtccgtaaaataaattattatacttacgccgcaaaagctggtggcgaagcggttagaaaaatgtgcacccaaaaagagggggatgtctatttccatgacatcgcgaactgtggtatggatgcaatgaaagcagatgtcatgtccgctatgaggactttttcgaatctatagaaaaacggggatgataacatgacaaactatgcagaattattgcaaaaaaacagcctttccactatggagagcaaagaagtctgcaatgcacttatgacagaagatcccaggatggagaagctgatcctgaaatactttcagccaaatgattatatgaaaatatggcagcgcagaattggtgatggcctcatcggtggaaaagcctgtgggatggtcatggcccaaaagttactgagcatttatctccccgactgcaaagaacacctgacttctccagattcctggttcataggctcccatgtctttcatgattatgtagcagagaatcagtgcgaagggctctggcggatacagactctaaaaaaagaggatatggaagagataaaaaagtttcaggacagactcctgtcaggtaaattctcatcccctgtgatacaaaaactggaagaaatattggacaattatggccagactccactcattatacgctccagcagcctcatggaagatagttatgaaaatgccttcacaggtaaatatgactcggtcatttgtgccaatcagggtacaaaagcagaacgtatggcagaacttttaaatgctgtacgcagcgtatatgccagcgtactgaatctttccgcattggaataccgcaaaaaacggcacctgttgaacaaggaagaacatatggctcttatcatccagactgtggccgggagcacacatgggcaatatttcttcccggctgctgcaggcatggggtgctcttataatccttataaatggatggaacaattaaatcccaaagcgggaatgctgcgaatcgtcatgggtcttggcacccgtgccgtggagcagactcctggtgactatccccggctggtcggattggaccgggcccgcgcaaatctccacccaacgatcgccgagcgtcacaagtattcccagcggcatgttgatgtcattgaccttgccgcaggagggctgtgtaccaaatctttggaggatatgactgaccttcttcctaaatgccagagaaacatgctgttgagccatgatactgaagcagaaacgctcctggcccaacgccgaatctatcggaacatatactttgcagactgccagggtctggttgaaaactccgattttattaacgtcatgcgaaaagccctgaacatgtttgaaaaagagtatgaacggcctgtggatgtagaatttgcggtagacacttctgccgatggctcctggcacatcaacatttaccagtgccgtcctctccggtcagcttccgccgaaggaatcacaatttccggaggtgttgaacacgaatttcttttcgatataaccggggcgtccattggacgttcagaagagaaaaaaattgattatattgtatgggtagatcctcagaaatattacgaatgtccatactctgaaaaaccaaacatcggacggatgattggcaagataaatcaaaaatttaaagatacggataacgggcggctcctgcttacacctggacggattggaaccacttcgcctgaactgggggttcccgtggcctatgccgatatcagccagttctgtgcggtctgcgaagtggcatatgaaaaagcaggttacttcacggatctctcctacggcagccatatgtttcaggacatggtggaggccggcgtgttttatggggcaatcacaaaaaaccggacgacaaaattataccgcccggaaatgctgaaacaatatccggagatcctgcataagtggtggcctgatgcaggaaaaatccgggaaattgtaaagctctatgatctgaccggcctccatgcatctatcatcctggatgccagggctggaagagctgtctgccgcattttctccccctgaggaacacatactgcgcagcaaggcccctgacgtgctgcgcagtccactgtatcttaaatcagccagactggtacataccagtttttttcatcaacaggaagtaactcatttgccatacagacaacgctccctgttcctatctctactttaagtgtctccaaagcatcaaatgttcctgacgcgcttacagggtctaacacatgaaaattttttatcgccgtttttccaggtgaagcagcttttttaatctcaatgggagacagtataccattctgaaaaatcagcaggtcaatttccttttgatctttatcccgataataataaattggaggctcttttcccgcattcaggtaacttttataaatttcagagaatacatagctctcaaaaaatgctcctgacattgcccctctttccagtgcctccgggttcccccattttaaaagataagcggccagacccgtatctaaaaaatggagaagcggcatttttactactcgtttcaaagcattattatgataaggctgtacaagcgcgatgatatgggaagatactaaaacagaaagccatttcttagcagtaggagccgtaatcccggccgcacttgccagttcctcgtacacaacaggtttggatgtatgagcggcggcaatcgtcataaaattataaaactgcatttcatcagcaacctgagccagatcacggatatccctctgtaaatatgtgtctacataggaacggtaataggtttcccagtcaatatggtcatcagcatagagttctggcatagagcctctgaatattctccggtagatctcatttaacccacgtgcctttgttacagataaacgctccaacaaacgcccggtatccgtggaaaagggttcatttggcacctgatagatctccgcatcggacaatcccagcaaatttacaattcccacgcgtccggcaagactttcactcacattttgcataagccggaaaacctgcgatcctgtaatccagaaatcccctttccgcttagaacgatcaacactcattttaatataaggcagcagctccgttgcatactgaatctcatcaatcagaacaggcggagtatatctttgcatgaacaaagccggatctttctttgccagatacctcacatcaggatcatccagagtcacatatttacgatccactccaagttcacgctgcgtctccgccagtttttgcagcaaagttgtctttcccacctgcctgggcccggttaccaaaagtacaggaaacattgtcgatatctgctcaatcgtcccctccacagctcttttaatatataccatctgaacctctcccttcaaaactaaattgcacaaatcagaaagaactgcctctccgtccattccaaattaccattttagtttagccaaaattaccgacattgtcaatcacatttccgtctattctaaaattatattttagtttagccatatcacttacatttcctgatcttataaaataatcaagctcccctcgccgcctatacacactccttttccaaatcgatccaccgcccccatcaaagcccctgccgcacccccctgggtgcgtccagctccgtgaaagcggaagcgggctgccccggggatacatatgccgtttctttgagcatatagcgcggttagcagcagtaagagaaaaagagcagaatcgcaggactggaaactgattccgaatcagtttccaaggaagcctgagccgtctaagcatcagcttaggcggtgaatgcttccgatgtcctgcgattctgctctttttctcttaactgctgcttaccaagcggactgcccaaagaaacggcatatgtatccccggggcagcccgcttccgctttcacggagcgtccccccttccctacctcttccgccgcccaaaacatatccctgcgattaacaggatgagtactgccgccgccccaatcccgatatacagtttgagcctcggctgttcatcctttttatctttgggcgtctcaacaggcgtatcctcctgtttattatctattttacgactgtcacttgccgcagtatcccccattagcttctgatacccttcttcagtcagggtggcttccgcgctgccgactgcctggcccttataggtatagatgactttaccgtctctaatcccgctttcggtcagaacaatattcttttcaagctgggaaaattctatcccgtccggcagtacgacataagcatcttctgtgttaaaattcctgatgtcttctgaagtctccagactctcaaccggaacttttttgaagttcgaaaaaacataatccatcatggcctttgtatccgtatacgcatcgactccataatcgtagaggactacagcggccaggtgcatatttccattgtctgccattgtcaccagcgtggtttttgcctgatctgtgtatccggtttttccgccggtacagtattcgtaataatagtaattctccggccaaagcatcttatggttctgttgaaatacacgttcttcctgcgtcaggttcgtagggccaatcttgtactccagttttcccataatggttctaaattcgtcctgctggtacactgcggatgcaatcagggccatatcatgggctgttgtgtaatgttcatcgtcatgcagcccgttcggattcacccaatgggagttggtgcatccaagctcttttgccctgtcattcattttccggataaatgtatcataatctccgcccaggctctgctcccccacactctcggcaaccgcatgggacacctcatttgcagaagccagaagtaccgcgtgcagtgcatcttcgaggcttaattcctctcctgctttcattccaatctgcgcgtcatcatactgcagaaaagagatactgtcttcggtaaattttaccttatccgccagatccgcattttccagagctaccagagtagtcagcagttttgtgatacttgcagggtaatgttttgcatccatattcttgccatacagaattgcaccgctctccatatccattaccacagccgaatctgcatatacatttggtccctgaggccagccctccagcccgttcgtatcaatcgccgcctcataagatgcggccttctcctgcagttccgcctcagcggcaagctcttcctctgtcttctcctgcgtatccccatcctccgccagcacaactgccggggaaaggatcaatatagctgctgctaaaaaacaaaataaaatccgttttaacttcataatttcctccagatttttattatcatatgcagaacctgcagaactcattcttctataaaattatttcataaataaaaataaaatttattattgagcttttcgtgttttggataagaatctatacattacatagtacctcaaatattggacacttacaagtattaaacttttgaaatctatccgccagcaagacggaagctcgttaacgaattcctaattttattacgcattccctcaacaatctccggaatgttttactctccgctgtcttttcatcgtgccccggcgccagatagatcatcctgccctttttataattcctgcaccagcccgcagggtagtcttctccctgatattgaaaagtaagaaaaatctgtttctccgaatccagctgcctcaccatataaggctcttcctctaactgaaactctttttctcccggacactttgcagtacgataaaccagcaggcagcggggaggatgcgttacgaagttcccgccgtatgctttttccagcttacttcctgcgcggctgataattccgttatgcagcgccagaagacggccgtcgcatgcaagataatccgcaagaatgtcatcgaatccattcagattctggtaatcgtcaagataactgatgatacagtcatataactgcaggtcagaaatagtcaggccgcggtaatctgtacatacgcttatctcccccagggattccagtgcctcccggatgccgggcagcactctgctaagcggatgataaggcgcctgttcttcatcccctaatatcataatctttttttccgtcaactctttcatacctcctaccagggaatgatgctcccgtcatagctgtccaataccagcttttcctgttcccgtattttgaaaaagctctgcagggccagccttgccgcttcttccggattcagatcggcgtgttcttctttggttcccatcatataggtattcatccatccggggtgatagagacggatttcataaccgtcttttttcagccggtttgaaagaactgccatacctgcgttgagtgcagccttggacatgcagtattcggtttcgtcctcccgccagcaggtcccgatgcttcctgcttccgaagaaatacagcagatctttttgtctgtgccccggtccataagcggaagaaatgcctctgtcacccgtattgctcccaatgcgttgacattaagcgtccgaagcatcccaggatagtcatatccatcccgaatgtcccggatcgtaccattgattcctgcacaatgaatcagcatatcaaccgtttccacacgttccatcaccttttgaaccgctgtttttacagaattatcatctcccacatccagcggcacacagatcaggcggtcaggataagtctgtttcaaggcatcgagttccttccattcctccatatacctgcctgcaatcacttgaaatgtggtttttgattctgcaccggtctgcctcccgctggttttcaaaaattcctcacacaatgcaaatcccagtccccggtctgcacctgttaccatcacagttttcctcatctccaaaatgcctcccgatactgttcttctctttctgcaaaatcacagggcaggatctcacctgtattttgaaaatgttccacacattttctcgtaggaattccggtacgcccgcccaggaccgtacactttatcgcggaaaccgctccggcaaataaagctgctgattctgcattcattccttccgctattccacaggtaaatgcgccgtgaaaaacatcccccgccccggtcgtgtccaaaacctccacaggataggatgctgattcaaaaaatctaccatgatccattcctgcacatccctttgcccccagcgtaacgacaactaccggcggcccctctttggacagaagccccagattcttcttgtactctccgtcagaataaagatgattgtaataatattctgatagtataaaaacatcaatattcctcaggtttctctgggtccgctcatcaaattcatccccatccacaacaacggttcctccgttttcatgtacatatttcgccatcttttccgccacggtatccatctgatacagcatcagataatccccttttttaaagatttcgtaagggatatccgcagcgttccacggctgaaccgtagatgcagattcaatatagtgctttccccgcttttcagaatctacaatactgacacaaaaagcagttctgccttttcgcatctccaggtgcgaaacatccacgccaagcacttttaagtcttctacacaaagcttcccatacctgtcattacccacagccccaataaatgcagtttctgcccccagacgcgcagcagcggcaaccgcatttgcaatcttgcccccgcccatcagactcacatcctgaaattccaccagttcctcttctgttggcatgtgcgggcacaaaatattcatgtccatacaggggtaatcaaatcctatgatcctcataaacacctcctaccagcgtgtcaaactgattttctctttcaaaaatgcctttgccgcctgcgccgcatctgccagggtacaaaatatataaggttctcccacatcttcctttatgttcttctgcaccgcataaaaaatggtctggtcgtatcctgttcccacattcagcttacggatccctcttttcacagcttccctgatctggctgtctggaattcctgtgcctccatggagcaccagtggaatggaaacctctctcttaatcgcatccaggcgctccatatccagcttcggctctctgacataattgccatgcgcactgccaaatgcaatcgcaagtacgtcacactccgtccgctccacgaattgcttcgccagctccggggaggtgtagccactgtcatccgcaaaatctgcaagcgtatctgcatttcccacatgccccagttcagcctccacatccacacccatagcgtgtgccgcttttacgacctcccttgtccttctgacattctcctcgaattcacaggatgaaaaatccaccatgatactggtaaatccggctttcaggcactgcattgcaagctcgtagctgtccccgtgatctagcatcagccccaccgggtactcgctctttgcggccagtgtctctacgatccgggcaaaagtatccacactgatatactctgtcatctcagggtatatcataacgattgtcgctgtcttcagctccgctgccgcctcaatcacccaattgatcgtttcaaagttaaaggtatcaaatgcagtcaccgcatatccccctttatctgcttcttttaaaatctctgatacttttactaatggcatatgtttctcctcctcttatctttcatcggcctcatcagccctgattcccgtgtagcgacatacttctttcaaaatttcactgtactttccgtggacgccgcatgcatgatggatatacgggccgtacatcagctttctctcccatctgctccaatcctctacctctacccagatataattccctccggtctccggtccttccacgcctttcccttctccaaaaaacatctggaaatctccgcagacacctccgaaccttgcaatcgtgagatcgcctccctggatttcataccgccccatacattcatccgtcaactccggattgcaggatggttttgccaacgatttcgggaacggtccgcaatgccacagcagctctgcattgtcattttccggatgccgtatggtcatgtccgcagtaaatgcaggggactccatcctggctgctcccgtcagaattcctgctgtcactgcgccgtaaatatctgtctcgcagatcaccggcaggcctttctccgtcaggttgccgaaggcatagcatggataacactcatagatcagtggattgacataccagcagtctcctgccataatcgtgcacccataagtttcagccagatttcggattgccagctctgtggccgctgtaatctccgcatgcttctccgaaatgctgtaacacggaaacgactgttttgtttcctgcaccagcttttccacggctccccgatcttccttccgaatacgttcgatctccgttaccagctctgtcccgtcaatgggtactgtatcaattttcaactggtttaccaaagccccctcgtccacgatgacgctcagaaaatctctcgggcgcggaccgatctgcccgatcttcatatttttcacagcctttaccgcacatgccgtgcggataaaattctcgattccctgctccagcttcggatcttccagccagcagttctccagataggtataggtcagcccctcccgaagaagccccatcgtcgtggcaaacaggccgcactgcgtgtccgtctgtcgatatccatatcctcccggaggtgcttcatcccttggcccccataccagaatgggcacagaaaactccctgcaaagcttaaccaccgcctcctcgttcccaaagttcgcgtggggcacaaacaaagcgtcaattttcttctcccggaaatactgggctgccctctccacatcacatgcctggtacagcaacgcctcctcatttaaaaatgaaatatccaccagctccacatcgccgattttttcaagaatttcatccacccgcctccggatcttcaggctgttttcatatgcatttttcggatccggaaaatcaaacctccttgtcggcgcatatcccaacactaattttctgtaattgtacataaacatcctcctaccttcaaaatctattttttattcattcatggcctgagcattaccttcattgcctccggctcttctgccgcatactcctttctttttttacggcagccattcctgtcagacaccctgctattgcaagcatcataactccgccaagaagcagcaggcttgcatatccaaaggcttccatcagcccccctgccagcatcggaaagataattcctccgagacttccgaagatgctgacggcattcgtcgctcccacagagctttttgggaattgctcacaggccaagccgatttccagtgggaaattcacacctgacagcaaaccgaccaggaaaattaaaacaatcatcatgaccggcttcgtaaccgcaagaccgagcgccagaagaaccgctgtgaccagattgacacataccaggtattttttcgtatcatattttgcaaataatacaggataaatcaatcgtcctgctgccgaacctgtccagtaaaaagtgatcgtaagtccggccattgcggatgcatcgagcgccagctccaaatagctggacatatacgtactgatcgtcatatcaaatcccataaacaaaagcgccgcaaaacaggtcatcagcagatgcggattttttaaaagccggaaaaacggctcttcctgtcccggttccgaccctgctccctctgccttcacttctgcttctccctgactcggctctgtctttttctgctttcttccaagaagcagaagccccgccagaagcaggaaggaaatcccgccgatcacgaagtagctcagcttccaattcagtccgcatgccaggataaatgtgggaaggatcggacctgccagagagcccagcccatagactccatgaaaaatattcagatacgaattgcgcttatccccggacaaatcagatatataagcgctcatcaccacattgagcaggctgatcgccgcaccatttacaaaaaatgcagccagcagactcgtaaaggaaaccgaggccgcaatccagaacattgagaccagatgcgccaaaactcccacggtgatcagggtaactctgggcatcctccgcgccagcatgtcattgaaaaatatcataaccagctgccccacgcacaacacggatcctacgattcccgcctttgccagtgggatactgtaggtttctgaaaaggcggaaaccagtgcgctgtacatgataaatccaaaagaagcaagaaatatcgttacatacatggctgacaacaatatttttttgttattcattgtgcttcctccatacgaaattcccagcggaccggttttgtaattccatggaaagaagagaagatttccatgcagacccagatatccgcctgtgatgcatccccgtccccctccatttttaacgcaagcttgtcaggctcttcatacggcttttctacttcgatcacatttacacgttttgcatcttctgttttgagctccactgtaatgctggcttttccttccagcagctcaaactgcaggtacaacggctctcccttccggtctttcgggatatccgtatgacagtggtataccagaaaaccgctgttcttccataaatcatgaagctgggttccatggccgatttccaccgggtgataagaaggcagatggctgtaatttccatccactttttccggctcctcaggcatccattctgccatttcccaatttgtgatatatctactctgtacagtttccgcctccggtaccttacttcccggttcacagatacttgtaagcgccgccttttccagccccctggcctctgcctggatttccaccctggtatcctgcacttctgctatgatctgggccttcccgttgtacaatctgcatactggttctctgcggttactggtatccttcacatccccgttgccggttaccagaagcctggcccctttcagcctggtaatctcaaatacattttcagcatccggcacctcccggcctgcctcgtccaatgcggttactgtataaacagcggcttcccggcagccgctttttacctgctggttctccagcttcaaagaaagctttttgggttcccctgttgtctctctcacgcattgcgcagccacgtttccattcaccatcgcaatggcttttaattctcccggctcatatgccacattccagtctgtctgaaaataagcatcgttcttcctggttccaagcaatcgcccattcagataaaggctgacctcatcccccgtggaaaatacccggactgtcacgttttggcctgccttcttcccgttccaatggggctggatatagacgaatgcctctccccgccaatacgtctgatacagataatagctgtcctttgcataaccattctggtccatacagccgcagggcgcaaacagccccggataatcatgttctccccggtagtccatccccgtccaggcaaacatgccgctcatgtatggcgtattgtccacaatctgccatgtacggattccggctgtccggttccccagaacatcttcctctgatgcattgttcacttctgaaaatacaatggccttctcagggtatttcttatggactgcttcacacagttcaatgttgtagttcattccaatcatatccgcgctttgtgctgcgccgtcttccaatagtcctgtgtgcatcgccatcagcaccggccttgtcggatcctgctcatgaatcctgtgcttcatggcattcatgatctttcttccgcgttcaccgtcctgcagggattcctcgtttcctgccgaccagacgatcacactcggatggttccgatcccgtttcaccatattttccagacgccgcagaccattcggcgaagattcgaaccagcggttttcatccatcacaagcatacccagacggtcgcatgcatccagcgtctcccgggaatgcggattatgcgagaaccgatatccattgcatcccatatctttgaggcgctgtacccggtactcctttatattatccggcagcgccgttcccaggccgccatgatcctcatgaatacacattccctttatttttgttggtataccatttaacagaaagccgcgttctgcatcgaattcagctgtcctgaatccaaatgtagtatctacttcgtccagcagcacctcaccgctgaaaattcttgttctcagctgacagagcgtgggatgctccaccgaccacagctttggatttctcacctccgcctgctgcatcagcctctttgttttccgtcccggtaccagctgtatcgattctgtttcaaataataaactgccctgttcatccgccgccgtttgaaccaccctgacctctctgtctgaaaatgcgtcattgcgcagtgtcgtttctatcggcacattccacagttttccatccctggattccggatgaatgaaaataccgcagtaatccacacaaaccggctctgtcttaaccagccatacgtgccggtagattcctccgccttcataccaccatccctcgtattcccggttatccacatataccgcaattacattcagctcgtcctcgtatctggcaatatccgtcatatccagatcaatttctgcgtatgcactgtcattcatccccatataacagccgttgatccaaatacggctttccgtacagattccttcaaattctatatggatgcttttccctctgtcggaaggctccagcctgaagaatctgcggtaccatgcattttcccggatcagagagccatgcaccggattggcctctggcgtgggtgctccctgcaccacataatcatgaggcagttccactgtttcccaaagactgtcatcataatctgctgaggcaggtccccttcccctctccgtttttgtatgcatatacgtatacagataaccgtgtgacacggtatcttccacatcccccctgtgaaatttccatcctctgtccaactgtaatttttctctcatatcatcgtcctttccattttccccgcctagcctttgatcgctccggctgtcattcctcctgcaatgcttttctgcgtcaggaagaaaaagacaacgaccggtatcagtgacaggcaggccgcggcaaatgcagcattcatattcgaaacatgctgtccgaagaaataaaactgctgcatcggtattgtccgcatttccttcttctgcagcacgatcagcccgatattgaactcattccacatccacagcatatgcagcgctgccaccgttgctgtgataggcttcatcagcggaaatacaataaaccaaaaggtgcgtattttcccgcagccatcaatctgcgcggcctcctccagctcaatcggaatggtcttcgtaaaaccgacatataaaaatgttgcgtaggaaacactggttcctaccatcaggataatcgcgcctgtatatgtattcatcagatccagacccttcagcattcgataaaccggaatcatgatcatctggaaagagaccatcatgcctgacatcagaagcagatccatggctttataaaaccgtttgccgctctttctgcagatcatataccctgccatagaagatgagataacaatcaaaatgaccgaaagcagcgttacaatcgtactgttttttaatgtcacaaagaaatttgttacttccactgccttgctgaaattctccaaatgcaggccggaggggagcgataaaatactttttgccgtctccatcggtgtcttgaaggcatttacgataacgatgtaaagaggcgccaggaatatcactcccgcaagaatcgtcagaagggaaagcagccctttgattcgtttacttttctttgacatctacgcttccacctccagtctgcgcaaagccctggacaatccgcctccgatcaataccagtgcaatggtaaatacaaccgagatggcctgcccgtatcctgccttgttataactcatcaaatgattgtatatatagataccgatcgtctctgatgctcctgccggtcccccctgggtcgccgcatacggagttgcgaattcacgcagcccataggtcagcgacagggttatgcaggtggtaaatgccggtacaatcataggcagcgttacccggaaaaactgctgtatcctggttgctccgtccagatccgccgattcatataattcctttggcactgtggtcagagaggaaagataaacaagcatattgatacccacatcaatccacatatggatgatggcaattccgagaattacggtactcttctgccccagaagactgtttaatccgaacaggtttctgaacacatcgcggaaaatgtagccccagataaacactgccagcacaacgctgatcgcggtaggaaggaaaaatgcagtccttgcaaatgtcctcccgataaatttccggttgattgccagtgcaagcaaaagagaaatgatattccccgcaatcgttgcaatcaaggtatagcagatcgtgttctgcacgggctgcagaatatctttattggaaaatatgttgataaagtttttaaacccaacataatttagttctttgctgaccccattccagtctgtcaacgcaatatgcagccccgaaaaaaacggaataatgacagaaaagccgaaaaaaaataagaccggcagcaaaaagctaaaatttatcagcttactttttacttttttattcataggtcttcctttcccggacaggcgccacggacggtgcctgtcctgtgtccactattctatttttgcgcggacagagccgcttcaaaccgctcatccagcatctcaatggcctcatccaccgtcatattttcattcatcagaagttccgtctccacatccgtcacaatcgtctgcagctcgtcggacacgaacagctcagaatacccagtccagtcaaacaccttatccgcatcaatatactgctggacgtcatagaggattccatcttcttccgtaacctctacgtttttacatgcagagatatcacctttcgtcttttgctgcagtgcccccatttccggtgtagagagcatttccaggaatttcagggctgcatctgcattttctgaatcctgatataccgcaaatccgccaggtgtagagcgaagcggcagcatcgcttccttagaatcctccgtcagcggaagcggaaagattccaagatttgcatccggattgattcccatcacagccgccggggtccatgagccgttgagaatcatacctgcatcccctactgccagcatattcagcgccgtattccagtctgttccaaagggatcatcattggtatactgataccgttctttcatcctctgcagaacctctgaaaaatggccttcgtccgccgcccaggttgttgttcctgcttccaggttcagacggttctctttgtcatattttacagttgttaccacggaatcgcactgctcgtcactgaacagcacccactgctcctggaaccccgctgcaatcggagtctttcctgcttcctgtatcgtcctgcaggtatcgataaaaccactccaggtatcaggcacctgcttaattcctgctgcctcaaatacatccttgttatatatgacaaacataccgccctgcgtaaagggcaggcaccatgttttgccatcgacgctgcatgcctcaactgcactctccttgatattttcattcagccattcttccccggaaatatccatacaaattcccgcatctataaactcctgttttttatggatatcatcaataaagaacaaatcggggacatcatccgccgcaatcttattgcgcagcatggagttgtaatcatcgctggagagcgtctccatatcaatctttacatccggatttttctcttcaaactgttcaatagcctgctccagaaaactgatcgcactgtcttcattcatatcatgaatcaacgtcagttttgtatctttgcgctctgccgcatctgatgaacctttcgccccgcatccggcagccatccccgcgatcattacagcagcaagcacaacacttattccttttcgtttcatagattttcctcctcttattatgggatttcctttgttgactctaatataaacttttttcttttatgggtcattttaaaaaattgcagtttcttaaaaaatactatctttatattcagaaacggttgttcccgtcacctgtttgaaaatcgtggaaaaataagaggcactggagaatcctacagtctcagcaatctcatgtgctttcatactggtgtttttcagaagctttttagcaccctcgaccctcacctgattgatatactgggtcagcttcattcccgtactgtttttaaaaatcttgcagagataattgggtgtcagccccatctcttctgagagaatttccagtgaaatctctttcatataatttttttcaatataattcataatcgcggtggcctgcctgctgcttccgccagacccgatctgattcttctggctgatcttcagaaccagcttttcatagtcttccagcaatgcagcctccatctcctggatagacctgaaccttcggcaccagccctctgtaatcaccttcacacccagaatcatttcagggtttatatgttcttctatagagatacggtagaaaatatgaaaaagcaaaaagcatgttctctgaaggctgttcttatcgggacgtgtctgatagaggttttgaatgatctgctttaactgtgcccgtgctctttcctcctggccctcatggatctcttccgccagatcctcaatggcagcttccagattctgctccgtcttcttctggtttaaagtggaataaaaaaacactttttcatatccttcatacaggctctgttcctgtgccctcagcgcctgccggtacaaaagggcaatatcaccgggatttttaaagctgtcgctgactcccatggaaaatcccgtaatatgctgccttttcatttcctgataaatagcagtcaccttccgggtcacatattcgaaaatacgcatggcgctattttcatgctccagacagaacagaactgccagagtctcaccatccatggaaatggtaaactcctgctctgatatatgttcattcaatatgttccgcgacttttcataagtcacctcatccggatcagggagtttcactgtcagcacggtcatattgcccggtttatccgtccttccggtatattcccagaatttctgcatatactcctgagaattcagcttatttaaaagcagattttttaaaaagtcattggaaataatggagaaattctctgttacaaactgagattttttatattcctctttttcccgctcaatttccgccgctatcttatccagtatggagataatttcctgctccttcaggtcatacttcagaatataatcccgggcgcccagcttcattgcatctttcacaaaattaaaatcatcatatgagctcagaacaatgcatttaatcctgggatagcattcccgcacctgctttagcagctcaattccattcatctccggcatactgatatctgtgagaatcagatccggtatctcttctttcagacaatccagcgcacatttcccattcatagcctctccgatcacctgaaatccatatgcctcccagtccataaaattccggatttcataacggtaaaacacatcgtcttctacaatcaatatcttatacacctgcctgtgcctcctctcttgtccgaaataacggaagccagacctctacaatgcttccccttccaggttcactgatataattcaatccatactcttctccaaaatattgcttgattcgctgtgacacgtttgccactccaatgctattcaacccttcatacctttcttcctgcacggtcagtatcgattttattttttcctgcgtcatcccgaccccattatcttccaccgtcagccggagctttccctctgaaacggatgaagtaatccggattatcccgtttcctttggatatctcgatgccgtgaaaaattgcattttccaccagcggctgcaggataaagtccagcataatatattcctgcacgccctcgcacagacagtattctacagcaaacttatcctcgtacctgaacttctgcagggtaaaataattccggatatactccacctcttccctgactgtgtggtattctccgtttttgcttaatgatgctctgagaagttcgatcagcgccgccgtcatttctgcgatatgctcctgcttttccatcttcgccatgcattgaattgaccccagtgaattataaagaaaatggggattgatctgagccttcagtacctggagtttaagcctttgtttcgcctgtccttctttataggccgcttcaattagctcttcaatcttatccgccatatagttaaaacgcgtacacagcatgccgatttcgtcaagactggtgggttcgatatgcactttaaaatcgccctgttctaccttccgcatgttccgctcaaggtaatggatattccggctcagatttcttgaaacagcataggaaaaaatcaatgatacaagaatcgcccctaccgcaatcatcataatataccatttaattgattttgcatttgccatgaaaacatgctccggtatcaaacagtatatgttccactctgtactgtttttgatgcgttctgcaaaaatataactctcattctggtaaagaatacgcgatatataattgccataccggtcttctttcctgctcatacggttgtctattccgtcttccatctgaaaatccccgtaaatcatggaactctcattattttcgaagaccaggctttcattgtcgatcatccggttccgggactggatgggccggaagaaatcctgagcaatagcaaagaccaccgttccatacacctgccccaattgattcttcgtatcaatcatattgcgcaccagatagacctgattttcttcttcctccagaaaccagcatgtattctttgcgcccatccggttctccgccatttcgagaatctctgccgcccgttcctggttgatattgctgtcattaaatgcctttgtatacctcgcccaccatgccggctgttctcccaccccttttacgtaaaaagcagtgactggcacggagctgctaaaatgtttattgccaagtgtccggatgttctgcctgtattttcccgtaccttcctgcttaatctgcggctccggagccttgatacactcaagaaacgcctcgtcggtcataagttcatatgtggtctccaacaaactttctgtgcggttttctaagttataggataattgttccaggaactcaccggtaaaactggccgtatttctgaagataacctgtactgaaatatactgaaaaactcctcccagcagtagaatcaaaagcagcatagtacttacatacgcaataaaaaatttggagcggattttcagtttttttgcccacaaacggattttttctatcagcttctgtgccatattctgttttccccctgttctcatctgtatattccaaaaggacatacaagacctcttgtatgtccttaattatactatacctcaaatcttacaggcccggttataccgcatttccagtgattaccttttattaccagtttgataattaaccggtctcctgtaacaatccccggcagttctaccctcatgcggcttccttccacgccgtgtttctccagataataacgtttctgaatgcggttcatgtaatcacgcatggagattaagatttctgcctccccggtaatctcctcgaacaccactgctccggtctttcccgcctccagatccggcatatccggctccatacaataaataatatagccgccgcctcttgtaaagtagaagggcatctggcggtccagcatcgatgcgctctccaggctctttctccagtaaatataattgtcatctgtggtataggcgtagatgtccggtttctcctggtaaatatgagacataaaccaatcgttaatatacggattgccgacactcacagacctttcccaggcaggctcttgtttctccgcccggccagactcttgttttctctcccgggcaggctcctgttccccttcccgaaccaaatatagatttacgcagcagtccgcttctttcagcatgccagaaatcctgattttcaacacacctgcttctgtcctgcaccgaaaaaccgccattccttttcctttatacagacacataacctctttctccggaaagcagctgcaataaggatccgcattatccgtgcacacacactctgccagttcattacatgctgtttcaaaaatatgggatgccgtgggtaccagatttccttctgtatctatggcctccacccggaccgtaaccagggcttcgccgtctgcaggatattctgtcttttccgggcagacccggaaggcatacgcctcgccgcttgtccgtatttttgctgttacccggtccgctccgcggattcccactgctttcagttcacctggttcataaggaaccttgaagaccgcatgctgccgtttatctaccactgcctcggcctgctttctcccattcacatacagcagaactttatccatattgctgcatactactacctcccgcattgcttcttccgtgggattccagtgtccgcatatatggagaacggggtcttccctccagcgggctgcatattgataaaaaccgtcttttttgtctccatttatattcagcggacaggcatctgtaaagaaccccagatttctgtgctctccccggtaatcctcaccggcccaggcaaaagtcccgccataataaggatggctttccccgaactccagtgtttcatacgccccctcgcttcccgaaaaaggattgccgcattctactacagtatccgccaggcagagcatctccgaaccgatgatcggcttgtttggatatctcttatggatctcttccagcttcctgtgattataattgactccgatcacatcgaccgcatcggctgccgtcctttcgccttctctgtccgcttctgtgaggccgtcatgcatagccatcgtcaccagcctggacgggtccagttcccggatccatcccttcatcgtctgcgcaatccggtaaccccgctcctctttctgccagggctcctcatttcccactgaccagagaataacggatggatggtttctgtcccttctgaccagatggcgcagatcttctcttcccaattctcccgtgtcaaaacgccgggtctcctccatgaccataattccatataagtcgcacagatccagcaattcccttgccggtgcattgtgggaacaccggtaagcatttgcccccatctccaccagatgctgtattctgcgttcatagaccgaggcatcgactgccagccccagattgccttcatcctcatgaaaacagaatccccggatttcttttcgttttccattgataaagaatccctgctcagcgtcaaaatgaatctcccgaaagccaaaacgctggcacagactgtccctgatctcatgttcccggctcagctccagatccagcagataacagtttccctcatggatatcccagagagccggagcttccactgtcatctccatgctgaggcatgccctggtgttatttggatgtatcccctggcaaatgtatgcttcccgctctgccgccagaattccctctgcagaaaagatacgtgctctgaccgtgcagtttcctgttccgccatatcgggcatttacctcaaaattgactcttactttccacttctcttttgattccgaactccccgccgtcccggtcttttcttttacctccggaagatccgacgctccggtcttttctgttacttctgaaggctccgcatccccggtcttttctgtgagaatctgaacttcttttgaatccagatacagcaggtctgttatttccagccacgccttgcggtacaaaccaccgccctgataccaccatccctgcatccatgtatgatccagaaatactgcaatcagattgacagaagcgccaaacctcactacatttgtaatatcaatttccacatcacagtaggaggacatctgtttcctcatcaggcagccattcacccatattttgctctccccggttattccgtcaaaatgtaaaataatacgccgttctttatccctggcatcaagacagaaaaacttcctgtaccagcaattttccgcgtcgagatatccattgtaatctctggcctgtggattcaattcctggagcacttcaaaatcatggggcagcgttacctccgcccagccatggtcgtcataggacattgcagcaggcgaaacctgtgctccggtcttagtcagatgatatgcgtcatattccatatctgctttcatttcttttgtaaatttccatccctcattcagatggatgattcttctactttgatgcaaggcggtatatttcataaacatcctccggtgtcagcgcgatatatgcgtcgccataatcttctgtacaattgatacgctcagaaagcattttaccgtctttctcaaaatcaatgccaagctcggataaggtaaccggcagccccacgcctgcaaagaattcttttgtctttcgtatcgcagcgtccaccgtcttctccggatggtccacattgatatccaggttccagacttcccttgcatagcgcaggagcagatgaaacttctccttcttcagatacgtcatccatgccggaagaatgacggagagcgcagcaccatgcgtcacattatagattgcccccagatcctccgcaatggtatgcagccccagattggtatacaggcccatcgatgcaaattttcccatagcaagggtgccgcagagcatcagctggctccgcgcctcgtaatcatccggtttttccagcgccgccgggagatattcgataaccgttttcatcacactctcgctcagcctgctggtcagcttcatatcctcaattcttccaagatatgcatcacagatatgggcaaagatgtcacatgccccgcacattgtctggtatgccggaacgccaaaagtaagctccggattcagcagtgcaaacctgggcctcatttccgtacagccatatccgattttggatacttcctccgtatttgtcagtacagcaaagggactggtctcgctgcctgtccccgcaagtgtcataatagcccccaccggaaggacctcatccggcctggcctctccactgtatacctcccagatatccttctcgaggcgggtcccaagggcaatggcttttgccacatcaatgcagctcccgccgccgattcccaatgtcatccccactccctgttcctttgcagtctgtattgcttccctcgttttgtccaacagaggattgggaaccacatcattgtattccactaccttcagcccttccgcttccagatagccgatcacccgctccaccagagggcgcagcggcccctctgcataggatactgtcataaccgtatccgtcagcgcaaactccctgcacagctttccggcctcttcttccacaccagttccccaataaagccttgtaccattttcaaacataaaatttgccataagaaccctcctgatattacacaactaatttctgaaccaatggtaacatcagaatgtgaaagaggcatttaaaaaaagagggattccttttaaaatattataataactaagtgtgcaggtactcccatgctttgctttataccactctgttcttcgactcaaaatacaacaatgcagagcagtatagtgcaatcagcaccgacgaaagtaaaatccccgccacaatatcagtaaaccaatggacaccggatataagccgcccgattacagttgctgtaataatgaggacggatacaatatccgacatccaaagccaagctttcctttctcgcagataataatgaaactgcagcatggctgtagccataatacagtttacaaacataacatgggaggagggaaacgatgcttctaaactttccgaaagaataatgggtctatcattgacaaccaccacctcaaaaaacaaataaacagcaataaccataacgtaaaatacgcccaacagtaaaatcctgcaatcgactttctgaatgcttttccgctttataagctggaatagccctaaaaccgcaaaccccagagcaaatactattgcgaaaactccaagccagtcagtaatatcataccataataggtttacaccgaaaaatttaaacacgcactggttgacagacgcaaggccaacttttgagcgatccggaccgacaggctgtacatccacggttttgaccataacagtaaaaagtataaagattaaaaacaatccccctgttatgataagatacttctttaatttcttttgcataatcaatcttcctttcttttgcggaaataatctatttgcaagctgcatttggattatcttccagcagtaccaaaaggacaagaaacctctcgtcacaatagaaaaaggccccgacactcttcgtgtcaaagggccttttctcaatgatttaaggctgatctgcctgtatctgcttccatagtaaaaatactttcactccaaaaaataaaaataatagaatcgttgcatatggctctcttgcggctgcaaacaaacagatggctgccgcgccggccgcaatcgaaattttagtaaaataacggaacaataactccttctcaatataaatgaatataagtctggcaatgccaagaccgattaaaaatgtaaagacagcccaataaatagtacggtctatattgggagtatgggtattagccagcagattcactgagtaaacatggttcccttccggttttccataaatcggaagtaatataaatgcaacagacaaaacatcgacgatcccgctgataaccatgtagatctttttaagattagaacggttctcagtttctgccagggtaatcaattcatcacttgataataattcatcaattgtaactgaaaaaagttttgatatgcattttaaagattcgatgtttggatagcccctgccactttcccactttgatatagctgtccgtgatacatacagctgctctgcaagctgttcctgcgtaagattgttattctttctaagttgctgcagcttttcattaaattccatttgtatcccctgtccgttatttgtattaggcttctaaggcaacagattcttcgataaactccccgctgctttttcatttttctgaggtttcgacgtatacctcctgcaatttattgtatacatattataacgttttatcaacactcaaattcgatgtaccgaaaatggatgtcaggagcgccagtctctactacgaaaaactaactcaaaaatgcatcacgaatcgtaagaagctgcaatctgcaaaatgatctagtaacttaatcgaacatttttacaatgtttggtcatgtctgatataataaaataaaaacccgggaggtacatatgaaaaatatattagtagtcataggcggcggcagagcaaatggaaatacaatgcagctggcagattccttcattgcaggtgcaaaagaggcgggacatcaggtggagaaaatatcattattaaagaaagaggttaagggctgtctgggatgtaatgcctgccggtttggaaaaccatgcatacagaaagatgattttcatgaaatgattcctaagataaaagctgccgatctaatagtttttgcatccccgctgtacttctggacaatttcctccaggttaaaagcatttattgaacgcttctactgtattgcagaggaagatgacaatccgccttacggcagatatgaaaaatatccggtaagagacagtgcactgttaataacatctgctgatgacctgttttggacatttgagcaggtaacttcctattacaaatttgctattgtaaattatatcggcttccacgacaagggcatgctgttagcaggcggatgcggagatacaaacggaaaacccagaatcagcgaaactggccatctaaaaggtgcttacgaattcgggaaatcactatacaacgcgtaatagcggactgaagagggacagatacgctacccaggccctctcccgcgccgccactccttccgcccgggtgcgcccagcctgtgaggagcgggacttcagccgcgggccgggaaacttccctgtccctttccgcgggcatagagcgcgccgtagtttcacttgagaaaaaccacatcggactggaaggctaaactctgcttccgaagcagagtttaagccggcttgagccgcgcaattcatcagaattgcacggtgaatgccggtggtgccttccaatccgatgtggtttttctctagtgaaacttggcaaacggacagcctgcggaaaggaacagggaagtttcccggcccgcggctgaagtcccgctcctcacaggcgtccccccattatctcgagtccgccacagccttatacatagcgagaagattctccggcggtacgtccggcatgatgttgtgttcctgattgaacacgaagccgccgcccggcccgaagatatcgatcatttttcttgtgtaatcatatacttcctgcggtgtggaacggtttaatacggatctcgtattacatccgccgccccagaaagtgatgtcttttccaaattcttttttcagggtcgcagggtccatctggtaagcggttgtctgtaccggattgagtacatcgtatcccgcatcgatcagatctcctatgatcggatatatggaaccgcaggaatgtaaaaatgtcttcatactactgtttttgtggacatactcattcagctgtgtgtggtaaggcttgaacagctctctgtatttctcctgggacataaacattcccgtatccatccccagatcgtctccgaatctgagaatatccacgatgtcgcccacggcgtcacatacgcagctcagggtagccagatgtctttccatcagctgatccacaagcgcttttacattttccggatccgcataaatatccataaggaagttatccatcctgcgcaggaatgttccccactcgaacaggttgcatccgcaggtaatcatcagtgccttgtccgtgctctttctcagttcgagggtgcgccttctcagttcgctgtaaaatcccttctccccggcgtgatcccacggactgtgcacaagagcgctccacagaaccttgcccatctgatgatccagatcggaataatcatccgggtagtcgtccacatacgggaaatatgtctggtcgaaaaaggttgctccgaccggcattttagctatctgggttccttctttgtctacaacgatgtagttgccgttctcctgccgtttcggccggaaccataccgggtactgtccgatagaaccatctgccagggtcacgtcataccagtcgctgtctttttcattaaacacgcgtccgatatcgatgacatccaccccaaactcgtcaatcagattctgttccggtataacgacctgctgcactacgtcatagatccgggtgtgcccgtctgtaatgcccatatgctttttcagattattataggcaatcgccgagatccccgagcttggtgttgcccccagatccagcggcacataatccggttctttatggtctattgccgccatcacacgctctcttgaattcataccaaaacctccgtccttaatctaaatgatagacctcttccatctcagcccaccactcgccttcttttctctcttcgagcggctgctggaacggcattaccagatcccaccactcctgggtcttcgggtctgctgccattttgtccatatctgctttataatcgtctcctgtatactcataatatgagaacagtaattcgccgaaattatagatagaataattggagatattgcattccttaatcattgcattaatttccggccatatatgtgcatgatgatatttgtaatcatccagtttttcctttttcactcctatgatagaaccatatctctgcattgctgcacctccgattttatactttattccgcagctcagctgctgatctgcccgcaggacatgcattacgaggtgccctttgggtatatttttctccgtttaatatactttctgtgcctcttcaaacagggcatggatattagctggcggtacatccggcataattgcctcgtggcttggtgaaataatcagtcctgtagggaagatttcacgcagttcttttactttattgcgcacatcctcagggcttccgtttacaagcaggtcctgggtatctacgccgccgcagaatgcaacctgatcaccgaatttttctttcagccctcttggctccatgcctgttgccagtgcctgaatcgggtgtacaatatccacaccggctccaatcagatccggaattacatctgcgatagagccgcaggaatggtaaattacttttacgccgtagctgtgtgcctgctcaacaaggcgtttacatcccggaataataaactggcgcaccatatcaggtgataacatcaggcctctctgactgcccatgtcgtttccaatcaggactgcatccagtttacctttagtcgcttcaaaaaagatcttattggccttcagatagaattccatgaccttttcattgactgcttcataaatctcaggatttgcaatcatattcatcaatgcagtttccatgccaaaagcggcgcaggtatcctggaagtgagctgaccagaggattcccagtctcacttttccttccggtgctgcctcgacacggcgcagacactcttcgggatcaatgtatttttcaggatccggccattcaaagaagtccagatcttccaactcctcggcatccttaaaacatccgtctgccgtcagggtccggtcctccgcatctacatcgccgtccatataccagtcaaatgcggcatagatggcgcttgcggtcggtgacttgtacgggacttccactgcataaaaatcatcgcctaccgccagttttaactcatgcatatccttaacgccataatattcaaataatgccggctgtgaaaatatatccggcatgccaagccatgctgccgggcggtctaccggtttcctctcaactgttgccaaaaaacgttctttactgttcatctgcctctcctctttcacaggtcaggcggaggttgatataccatcctccgcccgaccgttatctgctatttcatttttactaattcttgcttaccactgacatgggaggaaatcctctacattgtcagcgctgataatgtctgttccgatgtaagctactctcgggatttcttctccgcagaagtactcggacattgttcttactacaagacctgcatctgcctggcatgactgataacttgcgtatttcagctgtccgctctggatcagctctgcgccctgttttgaaataccagctgctacgataacgatatcttcacgtcctgctgctttacaagcttctgttgcaccgattgcctggtcagaatcgtctgcaagtacgattgcgttcaggtcgtcgccatattttgtgatccagtcagatacaacctgttttacagcggaagcctcaaatcctggtgactgaacgtcaagagatttgatgtcaggatattcttctgctaatgtggacattggtccgaatgtacgtgcatagtatggtgatgttcctacattatgtgtgatgtagcaaacgccgccttttccgccaagctcttcaccgagtttgcttgccaggtttctcatctgataccagtcgttcgggcctgtgtaagccagaatgttgttcattgcatctgcttccggaagtgtgttacagcagaatgcagggattcctgcttttgtgatcttcttgaactgctgtcctgcatggtcagcacttacaggaattacaacgattgcgtccgggctctcattgattgcctggtcaacatatccgtcctgtgttgactgatcccagttcggatcatatacgtcacatgtcattccaactgcttcacaagcttcctcaaaagcttcctgatagcatgttgtccatgcgtgtgcgccgtgtacaattacgataacgtgtttgcccttctgtccgtctgcaggagattccgggaattttgagtcatttgcatcatcccagtcaaggtactcataataatgccatttattaatatctgagtcctccagtttttccagttcttctgcatcaccctttgcttccggtacatcaaatgttgttccttcttccatcagcggatgattgtctgttgttttgagttcttcaattgcctttgctagaagttctttggattctgccaggttatccccgccctttgaatcctctgtctttgcatctgattttccagaatcagaatctttagaactgtttccgcaacctgtcaggctgactgcgcttaccagcataagcccgctgagcaatactgctacatactttttgaacatttttcttcctccttttgttttccttaggtttcttattaaaaacatgtcccgcatgtttctaatctgagttactttctgaacctgctcggattcgagaacctggcctatgaagccttgcccagctccttcatggcctctttatgcaggttcggccttgtaccaactgtcttgtttctgttgtacagagcaattgtttcgtaaacgatacatgcaatcaggattgctgcaataacaagtacctgaatttctgtcttcttgaaaatagctttcaggagcgcaatggctaccagtgacacccatgtccatacaacgcttccctttcctccattgattgcagtaccaccaataatggttgctgtcagtgcgatcatcagagggctgattcctttttcgcccattgtaataccggctgttcctgagtagataccgttcagcgctccgcccagtgcacatgccgctgatgaaataacgaatgccagtgtcgtgactctgtcactcttaatacctgccagccatgctgtctcaaggttaccgccgatcatatagacattccgtccgaatcttgtgtaacggagcacaatcataactatgaatacaacaactgtcgtaatcaggaagtaggttgaaaacggcaggaaggaaagcagattgtcattcagaacatcactgaatgcataatcttttccaatactcagctcttctccgcctgtatagatgtacatggaaccttttaatacaaactgcataccgagtgttgcgatgaaggaatgaatcttcagctttgttacaaggaaaccgttgatacatccaaccagaactccgaccagtgttgcaatcaggatacagacagcccagggaagacccggtttgtcatgcagtcccagacaaagcagcgctgcaaacgtggacatatacataatcgtcagatccatatgtcctgcaatcatacatgttgtaaatcccaagcccagccagattacaaggcttccgtttcctgtagcggcactaatgttgtacatggtatagaagttatctacaaaaagaccaataatcaatatcagagccaggaaaagataagatctgttttcattaataaaatttgcattaattttaaatttcttatttttcattatgctctacccaactttctgttagaatatgtattcagccaaacgataaacaggaatacaagaccctgtaccaggtatttctcataggttccaagaccaatccatgaaaggatgttgttgaggataccataggctaatacgcctccaaatgttccaactactgaaccttttcctccgtttaagaggcatccgcccaaaagtacggctgtcagacaggagaaatcgtatccggttccgttttcgtaggatgctgtcttacgcagcgctgcgaagaagatcccgccgatggaagcacagacaccgttgatgatgtaagcggtaatcagtgtttttgcacaattgattccggagaattttgctacttcatagtttgtaccgataattttcagcttctggccaaatttagtctttgcatgtataaaccaggcaataaccataataacgatcatgacaatcgccatcagggaaatatactttccgatataagttctggcaatggaaaagaatgtgcttgctgcatgctgcgcaaaatcagtgtcctttgctaccttatccgcatagagctgttttccttcccagattacacgtacgataccggaaagcagaaggttgaagccccatgtccagatgatcgggttcgctctgagcttaccaatcatgaaaccgttgatgaaaccgattaccacaccggataaaataccgatcagcattgcaaccgggaaaccaaagttaatagtctgcactgtcatcataccgcccacagccatggtaagcggaatggacatatcggtcatgttaccggaatatgtaatgaaaataagtcccgcactgaccataccgatcagtgcaaccgcctccaggatggactggatattgctggcggcgaagaatgtaccttttgatacaatcatacctataataattaacgcaactacaacaacgtaaatacccaacttattaaaaataagactgaacttgttgatctcttcttttcgtgtatctaccttgggcgcgcctggatttggattgttatttatttgttctgacatgatacgtactcaccctccccattagctgcaatcaacagtgaattctcattgataccttcttttggaatctcgccgataatgtggccttctcttaagattaccgcgcggtcgcagaggcctacaacctccggcaggtcactggaaagcaggatacatgcatttccctgtgaaacatatctcttaaccgcatcgtggataacctgttttgcattgacatcaacgcctcgtgtaggctcatccagaatcagaatgtcaacatctgccgccagccattttgccatcaggaccttctgctggttaccaccggagaagctgtttaccagtctgtctctgtctgctggatatacactcatttcgttgatcttttcatcgatcagcccgaactgtttcttaccgtcatagataatgccagggccgcatctgtcaataatacaggatgttacattgtctgcaaccgtctgaggaagcgccagtcctacgacctttctgtcctctgtcagatacccgattccgcccttgatggcttctccgagatcccggaagtgaacttcttttccatggatgtactcttttcctccgtcgatcttgtcaacccctgtcaggcctcttgcgatctcggtacgtccggaaccggcaagcccgcagatagcgaggacttcacccttatgaagttcaaagtttacgtgatgatagaatccccatcttgtaaagtcttccactttcagtactacttcatcggtaaccatgctcttatggtctgcatagaagctctttacaggctcaccaaccatgcattctaccaactgttctgtattggtctctgagatcgggaaagagtcaaccagcttaccatctctcatgactgtaaccatatctgcaatctcgaagatctcacttaagtggtgggaaatatatacaatagccagtccctgtttttgaagatttcttacgatctcaaacagtttgttgacttcctcgcttgacagtgcggaagtaggctcatccataaccaggatcttcggttcagaaccgagtacctttgcgatctcaaccagctgtgcatcacactggctgatctcggatacgtccagcgtcggatcgatatcatccaggccgacacggctcagcagcttcttagcttcctcgattgctttcttcttatcaatgaacaatgcgttctttttcggaaggcgcccaacaagaaggttttcatagatggaaattctgcgcgccagtgataattcctggtacaccattcctattccatattcttttgcaaggttcggtgtgtggagatctctcttttctccattgatatagatctctcctgtataatcattgaaaagacccgcaagcattttcatcagagtggatttaccagctccgttttcccccatgagggcatgtacctcccccgctctcacccggaaatcgactttatcaacagccagtgttccgggaaatctcttggacacgccacgcatgtccagtgcatacgcttcattcttagatgcgttacccatgctgattaactcctttcgtgttgctatttattgatttcaccaccggcaaatcctaaaacataactgtggcgttttactttggcagtatccagcagattctgataccatttatcatgcgcttctatgcgcatatcttcctctgcttttacctgccatgcctcagcaccttcgccggcgtaataaaccacatgaaaaccgctttctgtgtatatgacactgcagtctccaggcttgcgcccatcgtcaaacacccatttatcaattgcatcatccagagtgtctctggtcagattctcaaatgttccgtctgaatctgatgcagactcatattctgaagcaagagcttcaaaacttttctctgttttatcacctttttcccatgtctctttcagctcttccgctttcgcacaggattcttcatacagcctgtttactttatcttcataatcatcagcgctgctgtcctcaagcgccggatcaaccgggaagcagacatctgtgatgctggctgtcggataactgctctcgttcctgctgtggaacaccattacataataacctgaaccgtcatctatgacattaagatcgccgtcttttcgatctgaagaaaaaagccattctccgtaggagaaattcggatcatagtatgcgtcatcaaaagcataataggttccgtaatctttatattcactgctgacttcttttagttccccgcctttttccaccttgtcatgaatctcctgcgctatggcaaaggcattctgtttttcttcctgggtcggctctgtatctatatcgctggctttcacataaaaacgttcatagttgacaaatgtatattccggaagatgttcttcataatactctctgatctcatcctcacggaaactaaagtcagcctttaccttatcgctgtactccgccgccagatgggaatatgtgagatgcttcctgtaaagctcttccgtcatgccgctgccgtatatattttccaaatacttatctatactgattccggcattatcagcgctgctttttatatcttccagtgcagtatcaatctctttctgcgcctcagtgctcagtccaaatccttctttctcagccagagcagccgttcttagaacgctggacatagactccacggtctgatcctcaaaatattcgaaccaggactgatgatcgtcatagggctggtctttcagagatgtgctgtcatcaaacatatactctctgaactcactgtgttcatccagataggaattataataagcatagtagtaatagttaaattcacacagcttataccctttcccgtctatcgtcaccgcaggaaggagcttgaccggcgccccgctttgaaaaaacaaagctgcaagaattccaacgatcaaaaatactccgagtaccactgcaaaaattgtgatctgcctgttctggcgctgcttttttgcctgatgttcctgtttctttgtgcccccgctgttgttgatttttctgctcatagccacctcttatcagcacaaaggcctctttatctgttatccaaggatctcttttactttttccgcaaaggctttccccagtttttcatggtattcagcctccatatgtaccccgtccctgacggatgcctttccatatttggatgcgtctataaagtgcacaccgttttcttttgcaaatgcctcatatgcttctgcaaacctttctgaacgctcaaccgcgccttctccgaacatatccagaaagagcggaacatccttgtaagacggatcaatcaggaggggagctgccaagagtacttccggcctgtttcctgccatcggcaccgttttaaccgcgttcagatagcgtccgaatccgaatgctatggtataaggatctaccccgaatctggccttcagatcgttcgtcccgagcatcaggataatcaggtcaagcggggactgtgaatccaggcaggcctcaaaataagcgatgccggaaagtctgttttcgactggatcgtcgtggacagtggtccttccgttatatccttcttcaataacctgatactcatttcccagttcagccgccagaatccctgtccacctgacatcgtccggatgtctggtcccttcagccggaacggctccccaggtgttggaatccccgaaacaaagtattctctttttcatactgctgtttcctccttcaattcttcaagtacgccccggcgtacctgcggcgggccgcgcgtcatgctccgcatgacacaattaatctgcgcgcctctcccatccgccggaggctttactgcttgttagataaatttttttcgtgcttcatacaaagcaatgatattttccacaggaacgtcgccctcaaaatcctggctcggccccagaatatatcctccatccacattcatcgtcctgatgatgtattccgtctccgccctgacctcctccggtgtcccgaaaggcagcaggttctgtgtgtccacaccgccctgaaagcaaagcttgtctccgtattcccgctttaatgaatcgacttccattccctttaccttctgaatcggctccagtccgtcaaccccgcatgcaatcaggtttggaataatcttcctgaccgccccgcaggaatgctgcaagtaaaaacaattatatttatgtgccagctgaaccagctttttcgtattctccgcaaaatattcatcccacatctttgggctgaacaaaaggctgatctgcgtcccgtaatcgtcacatggccggatcagatcgatcgcaccatcgcctgcttctaacatccgctcatacatctccatataaaactggctgtaacggttcagcattgcctttaccatctccggctcctccgccatcagcatatagaaagattccgccggatacagatccagaaatacctgataaggccccggccatccgatccggatcgctttatcctgatgctggccgcaaaaacgcttcacagcctcatagtcaaaatgatcgggattcggccagtctctgaaagccatgagttcttccatcgtctcaacatgttcaagaggccttttgatggtatggctgttatactccacaccgttccatttttctacatattgctgtccaaaaggatgtgtatgcactacctccccttttgcgttaacaaaatccggtttcttaggcccgatatatggcggaaaatccattacccttgtgtcaatctccaggatatccataacctcttctgccgattcaacctgaaagtattgctgcatcttctcccatgcagtctcaacagcctgcatcgttgcagggacacggtccggagtcttgtgctcaaaagctgccctcacacgctccttactattcaattgatatccctccctcagagttcctcttcttgttaagctcattataattctgagggagtttaaaatcaatttaaattaaactttaaatttaaacgtttaaattattttgtataatcctcggcaacacgcattgcaatcttctcccatttaaacagccgctgtggatcatgccttacagttgagatatctttgaagataagttccacatggcactgcccctctgtcagctccataaactctctgatttccttctccgcctgagcctcatcaaaaatattgcctgcaacaatggccgggttcggctttctgctcataacatagtccgtcccaacctcttgaatgatcttttcactgttacaccagggtgatacggatattttgcgcagattgggtatttttctaagcatggaaaccttcagatccagaggttcacagcatccgtaataggtaagtccgaatcgcctgagccacttcaaatcatgttcaacggcgaattcccagtgcatctcaggagatacggttgagaatatctgtgcattggaacatccccacatattctttgcaagtacatggttcggattaaagtcctcaccgggaagctctgttgtatacccgtaaccgcctgagcctacccgggtgttattgcagtccagtgataacaggttctgttcttcaaactgatccagctctaccatccatgcctggaccattttttcatagatgtcgtgtaccatatccggcctcatgaccagatccataatggcttcctgtacgccccaccagcgtattaggtaatcccacggcgtataccatatatgggtctgccccacctttttgacagggattattcccgcaaatacatcccgcattgcatcataagaatactgcgtggccctttcataatgggtgaccaccggcatcttgatcttttcaatgtcttccggctcctggatctgaatcttaaaatgcctggaatagatctcattttcctgatccgtatacgcggcatccacatcttccacaattccaaaatccgtagagtggatcgccagcggacattcgatataggggttgactaccatgtcccccggaaagtggttccactggaaaatcgtctttttcagcgtatcctccagatttcttgcccagggatgtgtgcacttcagggtcagctcatcgtttatgttcatctcatgccaaggaatctcattgatccataccattggttttaccgatttcttatcattcaaaagcgtccagtttctggcattctcttcatttcttctatcacctgagatctgcgctatcctctctcccagtgtttttaagatatccttatccttctgtgtaagtataatttctttctcctccggaatcaccggtttgtgtgacgggtcatgcagcataatcttttcctcctttactatatgcctgccggttccgaagaaccgacaggttattccagatttttactcttttttccatcctaacactgcatgaaaaaagccacaacgctctgttgtggctttaaggttgctcaatgtgacattttttgtattcaccgggagtgacttccatatattttttaaatgctctggaaaatgtcttcgaatcactgtacccgcagtcggcagcagcctcattcactgtgctgcccccaatcaatgcctgagcccccacactcattttcctggtatagataaactggctcgggcacatgccgaatatctctttaaacctcctggtaaaataggaccgttccatacccgcacactctgccagctcctgtacccccggattctcagcaatgtgctcatcaatatacttcagcacacgcttcatgcgccggctgctcgtgcggtaaatcggcagcctctcattgatccgcttcaaaaagatatcgaacagcctggacacgtcctgaaagcaggcgggatcacgctgcaggagccgaatgctgtgcagcagataatacagctcttcatccgttcggacctcaatgcaggtaaaattcatagccagagagatatccatctccacatggaaccagagcacttccagcggatcgtccagatcatgccgcagagaatagggctgcatcacgggaagtacataaaaataccccttttccagctgcacctcattttccccctgccggaaccatgcctttcctccgcagacataatacatgcggtaaaatgcggcgcattcgtccgtcatgccccagtccggagggcacaacgtatactcattttgtataatcttaaattcaaaatgcacagcgtgcctccttctttaatcgtttaacttaatattaaattccgttgacttttttatttacttatgacaatattattataaaatttggagaaaggcaaggagggattcttatggcaacattaaaagatgttgcggaaaaagcgggcgtttcgattgcgaccgtctcaaactgtattaataatacgaaaaccgtaaaacccgctacccgggcaaagatcatgcagatcattgaagaattaaactatattcccaatgcatccgctaagagcctcaaatctgaagcatccagagagatcggagttgtattccctgatattgatgactcctgtcatgcagatattttaaagggaatcatttccagcgcagagaatatggattatacattaaatatttccttctcttatcacacgccaaagctggagcgcaaaatcatagaccagctcatcggcagaaatgtagccgggatcattctcatcacatgtcagccccagaatgcagactatttccagaacagcattgtcaggcataacattccaaccatatttatcgatcattttcccgataatatagacgcaaacttcctggcatttgacaattacaattcctgttactatctcactaaaaagctgattgaaaacggttatcacaatattgacctcatgatcgggcacagcgattacttttctgagcgtgaatgtgtccgtggatttaccgatgcccacgatgacctggaactggaatttgacccctgtcagatcattgaaacacgctttacaaaagaatcctcattccgcaaggccatgttcaacatcgtagaaaaaccgcctcaggctattattacgtcctcacatccgctggccaaaggggtaattgaagcatttaatctctgttcaatcaagattccaaaagatacctgtatcatcactcttggagaagaatcctggaatgagagcaactatctgccgaacctgctgcacacgtcccgtacggcttacacgcttggcatccgcagcatacaagacctcatgaagaatcttcaggagtcggcattttttgaaaaggagttcatgctcttcaaggataacgtaataggaagccacatcaagattcccaaggctcccattccctaccgcatccccaaaactcccaagaggacactgcgcattattgccacctctatgcccaccatcctctcgttacatgcagtatccaaagagtttgagcggcagcatgaggttaaaatagaatttgattttgtaagctacagagaactgatcgaaacgatcgtcgcagacagtgccagggaaaaaagtaaatatgatgtatatatgtatgatatctcatggcttacatatctggtaaatttaaatgtgctcacagatattaccgaactgattacctccaatgagatgtttactaagcatcttgttcccaagaacctgtccaatgcatgctataaggggaggtattacggatttcctatcgtgggaggctcccatatactgttttacagaaaggatttatttgaacagccgtccatccagaaccagtttgagacaaggtacaatatgccgctgcgcccccccaaaacctggaaagaattcaacggcattgcccagttttttacgaaagaatttaacccctattcgccgactttatacggaacatccgtcattggcagcgtcaatgaggaatttgccctggagctgcagatacgcctctggagcttcggcggcggcttgtatgacagcgccggacgcctgaaactggatacaccgcaaaatgtcaaggcactgcagagtcttctggataccgcccgctttacggaacacggcatttccaatacttccatcaattccagtttccaggacttcggaattggccgcactgctatgcttctttcctttacggagtacggaactctgatcaacgactgcctgcacggggatattataacgaaaattgattacagcatgctcccagggcagactccggccaatgtagggtggcatatgggtatcagcaagacaacccgccacacagaattaatagcaaactactttaagtggatatcccaaaagaaaacaagctactatatgacgactttaaacgggcagtccaccgtactttacccctatgagaaccaggagattttaaggctttatccctggatgagagtgaacacaaagtgcatcgagaaatccaggaaccgggtctatccgttccaggctcccgacaggatcgtacctccatacgagatagagacgatccttcaggatgtatgtatccaggcttaccaaaaagagctttccccgcaggatgccctgcgaaaaggagagagcaggatccggaggctgtttcaatagaagtgccgcttaagtgtccggtacagaaactccggctcaatgggctttgcaatatgggcgtccatccctgcctcctgggctttcgcgacatcctcctgaaacgcattcgcagtcatggcaataatcggaattctgcctgcctgcggatgtgtgctggaccggatcgcccgggccgcttcatatccgtccatcagcggcatctgaatatccatcagaacggcatcataatagccctcctttgattcagcaaaagcctccagagcctgggagccgtctgcggttgtatccacatggatacccgtcatctgcagaatctccacggcaatttcctgattcagcgcgttgtcctcggcaagaagcaccctgcgtccactgaaatcaaagtcctgcgccggattatctgccggttctttttctttaccttttccggtaatgtccagcaatgtgttgtaaagagacgatgcaaacagcggctttgtaagaaatttgttcactcctgccgcccgtgcttcctcctctatctctccataatcatatgcagtgataataataatcaatgtatgatggcccacaatagacctaatttttctggccacctcgactccgctgatctccggcatccttagatcaataaaacagatgtcataatcctctcctgcttcgtgtgactgccggatttcctccacgatttccatgctgtccgtcacccattttgcatcaatcccaaacttttgcagaagcagggattcatactggcagacatcctggtcgtggtcaccaataagcactttcagcgtatccatctccggatatttttcataagacctgtcagaatccgccaggtcaaagggcagttccactgtaaatgtggtccccacatttatcttgctttttactccaatcgttccccccagaattgtaaccagattctttgtaatggacatacccagtccggttccctgcatatgggaatatccctgcctgcgttcctgtttgaatggctcatacaagtgttttagaaagccttcgctcataccggttcccgtatcagagacggtaaacctcagcctgacctgtcccttctgtgaaaacaactgcctgacatccagcctgacatggccgccctcaggcgtaaacttcactgcattagataaaagattcagcagtatttgattcacacgcatagaatctccgatcagctcttcctccatcactccctgtatggattcatcgaactcgagactcctgttggccgcctgtggatggataatcgcagtcaccgactccagaagacgtccgagatcaaacttttcatgggaaaccgaaagcctcccgtcctcaatcttagacatatccagtatgtcattgatcagggaaagcagatgtttcgaggaaaaactgattttcgcaagacagtcctgtatcctttccctctcatccatatgcgccgcggcaatcgttgtcatcccgataattgcattcatcggggtcctaatctcgtgtgacattctggaaagaaaatctgattttgccctatttgcgttttcagcggactgcagcgcatcactgagctgctgagcctgagctttcagttctttctgcatctcacgcagctcttttacatccgtgacatcaatgtaaataagcagatatacaggaaaaccgccaatccagtccacgcagtccccgttaatctgcatccaggcagtctgtccgtccttattcaacatctttgccagaaaatgtacatgttctcctttttttatacggctcatctgggacaaaattacgtctctgttcatatccagattcatccttagagtctggtctgacatatccccgcattttctggttccgaaaaattcctggaatttatcatttgcatctaacaatttcacatcccgttctgtttttaccaaaaattttgcggcaaatccgggaatgttatgatatgtaatagcctgtattttttccatttcaaccaggtcgttgatatcggtaatgactgtataagcaatcggaataccctcaagaacttcctctgtaaaactgccattcatcctcacccacttatgcccgcctccttttaccggcatacgggtaataatgctgtacccttctttcccggtctctgccgcctccagtaccgccacgcgtatcttattcagttcatcctcataatgatggctcgtataatagatatccggtctgttcctgaactttgtctgatactcttcttttgcataaccgatcaggtcatagtaaaaatcattggaccataccatagtataatattcatccatcagatgtttgctgacactcacctgcagcgaactcatcagcatgatatattctgcctctgacttgttttgtttcaggggattcttttcctccggctgatattcttcatccttctcattctcatcttccatctcattgcctcccttcatctattgagcacgctcggaaattctcctgcgcccatctttgcggccgagtttccgggagtaaccctattcactcggaatcttggcttttatttgaccgcgcttatcctgttctgatttgtatggtgtaatatcgtggcaggccagcagacatgcctcatcactgtcccattttatcaggcacgcatccgcgatggaccagacatcaagcactggattgtacacctccatagttttgtttcttttactctttattccgctgacaggacataactcacaggggctttttctgtgaaaaaaggcttcaaagcagcacatccctgtccgtgcatcaggtactgtctccctcgtttttgcattaatgtaaagaaggcggtaactgtcaggatcaatgacatagatccatgaattctggttgtccagtatcatatccagattctcagcagcctccagagcacggtcctgtgccctcttcttcagcagaaacgtggataaaaattctgcaataaatttaagcgcatcaatctggttcctcgtccacagcctcatggccaggcagtcgtcaaagcctacaaaacctgcaaacctgccctcatcgctcaccgcacactgcagcatggaccgtatgtttcttgcatataaaaacggatgtttttcctttgaaaaatcagaaatatcctgacagtaaaaaatcccgttttcgtcaaaattgttctgatatccgctgcccaggagcttatactcaatattacacagcctgccgatctcaggttcgatcccttcgttgcaccattcgaaggtattggtacacctcgtgccatccactgaattttcaaatatatagacacggctgacattatagcgcatccccaccatctccagaatcgaactcacggctttttcaatgtctcctgattcatataatttctggaatgactctgggacaatactgtccacgctaacctcttcttccccatacgattcgatccgggtgcctgccgccgtactctgttctgcattcaatacaaatgatttctgcatcactgctgcatcgtaaaaagcatagccgttcttgcctctctgcttagcttggtacagcgccctgtcacacttctggaacagattctgaaagtccagtccatcctccggacataatgcaataccaatactgcatgttagacaaaggccggagagtttgtcatgataaacacttttcaatgcccggataatcttttcagccttgatatgcaggaattctccttttgagttgtattccaaaaaaaccaggaattcatctcctccaaaacgggcaatgatatcttttcccctgaaaatattcttgatcttatcggctgcttccgtgagaacagcgtctccaaacatatgccccatagaatcattcacctgtttaaaattatccagatcaataatcatcagagcaaacttcgttcttatggcagacgatccccctcctgcaagagtatcgttcgcagaaagcgtctgggtatatccggcttcctctgcccactccagacggcgtctgatcttttcaactgccgtatctttattgaatactttcgtcagcgaatccatctgcactttagcagacaactcttttatccggcgcttttcatcgtcaatatctatgatgactccgatcactctgactggctttttctcctcattgaattgggtggttacgcggattctgcaccagaggtactttccctgcgcgttggcaatcctcacttcagtttcaccatacggaatacccgcagaagcgcttttcatcagctccaggagcgcaggaagatcttccggaaagatatgggaagccttttgaatttcagtaaagatattgtttgtcagaggcttataaccgaactttttttcccagtttgaggaataactaatgacatgcttttcgagatccccctcaaatgtaatatcattggtctgattcataacaatgcggtagcgctccattgatagtgccatctgctcctgaacttttttgatcctgctaatatctgtcaggatacaattcacatattcaatcccgtccgcacctatgatcagccggcatttttccaaaacccacagcgatgcgccttcccttgttactattcgatactccagcgtctgtgctctgccctcagacaactgttccctataatgcctaagaactgcacgttggtcttttggatgaatcatctcaatataccggtcatggaacttctcttttatttctcttctgctgtatccaaacaacgagataattccattattcaggtatgtaattgtaaaccattggtcgttcatacactgcagaataccggcgggaaggttctccgtcacaagatcgtgtccggatttctcctgtgtctttgcttcgacgttttcctgattttcccgttcccatataatcagtactttatgttgtttgggattctcgatatttactcgcagcgacgttgctttataccagatatattctctggattcacggtgcagaacccggtagctgcgcgtctgtttgatcagaccgtgtttaaaaaagttctccatatatccacccaggattccttcaacaagaggacggtcatccggatatactgcatgttcaataaaattactcagcgactcttcaaaggtgctgcctgacctaagatcctgaaaatcctcgttttgctgataaactagatgatagaccccgctgtccatatcgagttccaccactgtggagtccaggtgcctgagcaaagcaaaatatttcatctgctccagtttcggtacattttcctgatccgtatgcagtacaggctccagggtgtcctggtatttaaatacagtacccgaaagattgccgtccgcatattcacgggtcagatgaaagaacttttcccgcacattcttcagacattccagcagtttcggagagaacattccacactctccattaagtatcatattcaacgcccgctccggctgaatggcctttttatacacccggtcagtagtcagggcatcataagcatcagcgatccccactgcctgcgcataaaccggggtattatcccctatcagcccatcggggtatccttttccgttccaacgttcatggtgatagcggcagatattatatgcatatttcagatactcttcatctcccattttgcccagactggaaagaatctgacaccccctaaccgtatgcgtcttcataatttcaaactcttcgtccgtaagacggcccggtttattcaaaatggtatccgcaattgctatctttccaatatcatgaagtgccgccgcttccgcaatgacctggattgccctatcattcagctcgtattccggacaggaatacatgacattttccaaaagcacgcctgtaaacttgcggattcgcagaacatgctgcccggtctccgcgcttctgtgttcaataatggaagagagtgtgtccatgattacatccctcgattccctcactttcattgtctgttcttccagcatttcttctaggtgcatcttatggcggttcagttctattgcattacgaacccttcttctgacaacatggggttcaaatggcttgataataatatcagatgctcccatatcaaaggcacggacttcattttccatagaatcttcggaagttataataataacagggatattagtcataaggccattctgccccatttcctgcataacctgaaatccatcttttacaggcatcaccacatccagcaggacagctgccagtgattcccggtactgttttatcagcatcagggcctgttccccattttccgcttccagaagattatattcctgctcgaacagtacatggagaatcgcacggttcacttccatatcatctactattaaaatggtgtcccggttcattctcatcccccctggcgtctcctgccacattattaaccagtgtatctatgaacttccttctctcttctcttttatatatatccacgccgctgtacatcttaaaagtactggcagacataatcgccacctgcagaggctgtagaatctgcagcgctataatacgaagttccagctcattctttttattctgaaacagctcttttaacatgggaatcagatatagttccacctgcatgctgccgcgctggagctccattgtcagcatgaattttgccagtttttcatatgcttcgaacagttcgtagatcgtatccagcatatttttaattctttctgccggatctatggactgcatttctgatcggttcaaaatgtgtgctaccgcatcatcaacccttttttcgattgcggctgcaagaagattgtccttgcttccaaaataataatttattagtccggttcctactcctgccagtttagcaatgccgcggacagtgattttatttacgtctgtattttcttttatcattatgcctgcagcttcaatgattttttcttttgtatcctggttgcagttcataaatttgtttctcccataatccctctgtgtacttctatttttaaatatattgtgttcactttattatagaatattgaatctgatttgaacatgttcaatatagtaaaaagtatagtctttcgctatccttttgtcaaactctttgtccggaaaacttgtattagatgttgtaatgtcaatggacggttaatgatagagataccgcagaggtaccataatactcttttgctttatcctcagacacagtaaatcttttctgcaattttctataattttatctttgacaaatccttcctcaatatcatccagtaccaatgcttgaatgccctgctctattccctcattcaaagcccacgtttggtagggaagtagcttttttcggggatttggtgcaacccactacgcggaaatatcggccagttccgcaagcgcgatagtaccgacaaagttataaacaatctcgatttcctgttcccgtagcggttcgtgcggcggcgtttctgtgttgttcgttccggaacgtgagctaatatttatggggtatcaccgcgggaatcgagaaaattctgatctttggacgatacccggatatatccataagtctgcgctgacatattgttacctcctgtgaaaatcatacaggatcacatctccagcgccaagcatttccatccttttccggtcagctctgccatatatttttctttaatctgcattaaacaattttctttttatttaccctcaatttcattttttgctgacagaaaccgcctccaatatttcaagttggcataagaagatacccgcttcatataaactatatcatagacgccacctaccactcctacaatcgggattccctgcagaaacttcatatacagtagttcttttgacaataaccgggccgtcttatgaatctccttttcccggctgtaattttccggcagctgaacagttctaatatattcattcactttgccgtttatttggttcatcttatcgccgtacgatactgctccctggatcagcaataacacaaaataccgctcttcctctgagtcatattcaaaaccgtaactcagagcagtctcataaacgttctttaatatcagacctgtaaagagcggaatatccggcaaaccaattcctaaggctcccagaccaatccctgatacccctgagagtaccagatttttcgcctccacaactccagccattctggaaaaagcacgcagagaattgcggttctgacgtatctcgtccgcatactgattgacctgacaggtcttttccagttcttcttttctataagtcttttcaattattgcagtccctttttcaaatatcatagaaaatgccttggcaaaggctgcatccaacgtatgctgcaatttttccggaactttctctgctaatttttgattcagaagggtatccttcttttcctgccgtccctttaaaaagacggattccttcttctctaaacgatcccattccttttcaaaaggcgtttttttatgaaacatttccataaccggcttacctccctaaaagataaatatcttaacccgcgcatatttgctataaaaatttcattcttttttatctaacaacatcctaattaaatgtaatataaatcgtaacttggtttaatataacataaatagcacattaatttacctgttttggatattctttagaaagtatttagtctgctgcctcagaaacacttttacttgaaagacattactatataaacaaattgcaacggcaccttatttcatcaaagtctcttacccggatattttatatacaaatgttttgttgtgtatttatgattagacttgaaaatgcgaaaattgtccatctgttcagaaatcactttccacctggcttttactggtggcttactgggttagcgaaatcatggcggctatcctgcataatgattttatcatgatccctttttcgatatttcggctatttacagtgatctcactgactttgatgctgtttttctttttcagacttcccggatatgtatggccccgctatgcacaaaaaggagatggactgatctgccccaggcattttttgccgaaatatttctccttgtcttcctgtacggccttcttgcatcatagaagcttaataaatacagaaaaacaccgaaaaccttcattgcagcatgaaggttttcggcattctcttttcagcgttcctgggcggattcgaaccgccggccttccgcttaggagtatggcttaccatgtgatacacggttcggatgtaacttccaatatcatcccttacgcagaatgacttgtagtaaacgaactttatggtgcaaaacacctattctgacgcagttttatgtgtccgttgggtggtcctattagcaaattcttagcaagaggacacccagccaaagccgattgctactgccattcttcactcccttagtcaaaatgacaaggcaaatacatggaggttactatggacaagaaagagaaaaagtcactgccggaaccgcgcacatataccgtggaacagattgcggccatgctcaacattggccgcacaaccgcatatcagctcgtcaagcaggaggagttcagaatcgtccgcataggaaatgcgatccgcgtctccaagaaatcttttgacgagtggctggaaagtttggaattgtgaatatcgcaagaaacgccgtaggctcaaaaaacctatggcgtttttttatacccatttttgaaggaggctggcaatgaaactgacagaagcagaaatgaggatggtgtttcagattgaaagtaccaatcagaacgctgccctgaatgagatttacatgacatggcgctatgcgccgaacccggcaacgaaagaaacggcggaaagccttctggacaagctccgcccactgtcggatcaggagtgcatggatttgatccgcaaggtgcaggccgaataccgtctgccggagaaagcccgtaccatcggggaaatgctggcagaagccaggcagcaatccggggcgcagaagttatccggccatgacattatggctttggagcgtttcgacccggcgaccagacacatgatcgtctttgatgttcttacccatgactcgcctgttggctggaagggtgaaaaaatgcgactgttcctgactgacgccggatacagcaaggctttggagaatcaggaaaaggggcacatcaaaatccgcaatcatgcgaaggtgctttccggcgatctccactatgaccataaagaccgtgagaggtagccgcccccaaaatgtatcaaaatcagcggaaaatcttctgtttcttcctctgtggcttgcgttctggacaggacgtggatgttttcccatgcaggaggctatggaggcacacagacgggtaaaccgctcaaaatcaacactttttattttcacaggaaggaggtgcgaagatggctgtttttcgtattgaaaagacccgtgattatacggtcatgtcgaactatcacttgaaagatcggacgctgaccctgaaatccaaagggctactgtccatgatgttgtcgctccctgacgagtggaattataccaccagaggtcttgcggcgatctgccgggaaggtgtggacagcatcggtgcggcgttgaaggagctggaaacccacgggtatatccggcgcacacagcttcgggatgaaaaaggcaagatcacggataccgagtatgtgatttacgaaatgcctcagtgcgagccgccgtcaagcccaggtacgcctttaccgggtacggcaaagccatatacggaaaacccggatatgggtatcccggatacggcggaaccgtgtacggaaaaccccgcacaattaaatactaatcaaacaaagactgatttatcaagtacggaactatcaaatcctatccaatcaaatccccctacccccgcaggggcaaggatgggaacggatcggatgggagccagagaatgttatcgtgaagtgattttggataacatcgagtacagctatctggtgcaggacagccacatcgaccgtgagcagcttgacgagatcgttgacctgatcgtggataccgtgtgttctgcccgcaaagtcatccgcattgccggagacgattatccggcggaggtggtaaagtcccggtttatgaagctggacagttctcatgttcagtatgtcatggactgcatgaaggacaacaccacctatgtccgcaatatcaagaaatatcttctggcagcgctgtataacgccccgaccaccatcaacagctactattcttccctggtgcagcacgatatgtacggggacgggcaaagggggcgaggctaaatgcaggaggaagtaacgcggggcaccgtgacactcattgttggcggagccaagctaagtgagcaggtctttgaaaaggccgtcaaaaagttcctggaggaaatccagaaaagccagaagcccaaaatctaccgcggcaggcagagccttaaacagcttgccagccagaacgccggtcttgccaatatcgagatcagtgacaagaatatcaaggctttctcccgtgtagcgaagaaataccatgtggattttgccttgaagaaggacaccactgcagagcagcctcgttacctggtctttttcaaaagccgggacgcggatgccatcacagcggcatttcaggagtttgccagccggaaaatgagccgtgaggaaaagccctccatccgggaacggctgacccaggcgaaggaacaggcggcggagaaagtggaacaccgcaccattgaccgggagaaagtaaaggtcaaagatcggagcgtgcagagatgaacatgaaaaaactgtttttgctgaatctcccgtatcttctgttcgtgtatcccttcgataagctggcacaggctttccggcttgcgcccggtgctgacctttccggcaagctgctctccattggggacggcttcacggcagccctttcctccccgtggctcagtttccatcccacggacctgctgatcggcatagcgggtgcggtgatccttcgcatggcggtctacctgaaaggcaagagcgctaagaagtatcgccacgggatcgagtatggttctgcccgctggggtacggcggcggatatcgctccctacatggacaaggactttttccaaaacatccccatgacgcagacggaacggatcacgatggcgagccgcccaaagcagccgaaatatgccagaaacaaaaatattctggtgatcggcggttccggcagcggcaagacgcggttcttctgtaagccgtcgctgctgcaagcccattcgtcctatgtctgcaccgatccgaaaggaaccttgctgccggagatcggcactttcctggaacggaagaaataccgtatcaagtgcctcaacctgataaacttccgaaaatccatgagatacaacccactggcctacattcggtcagagaaggatatcttaaagctggtgaacgccctgattatgaacacgaagggcgaaggcgaaaaatcttcggaagatttctgggtcagtgcgactcgttcgctggcggtaagaagtcagcggacaaacaacaaaataccgttgtttggataactggtaattcgacaggtggaatgacggggtaacgccctgaaacgcctgccctcggtgggcgtgcatcggcagcaaagccagtgtacgaagccccacgacaacggctgagagcaaccgtagccgccgccaacggcggccgaaagcggtctggaggcagactgtgttgcctatatgccaagggtccacaaaatacccatggttagaatgttcgccgtagcgggcgaactgacgaatccgcgaatgtacgggtctataagaagaccatatagaaatgtatgggtgcgtttaagcgcagccggtgtggtttagtagaaattggccctacgaacgaccatgttgtgttacaggcacaaccccgccggcaggctcatagtggaaacctaaaggtataaatgcacagataggattaccggaacgaggaaagacagcggcttccttaaggaagaatctgacgaagaacaataagcaggtgaaccgctgctgaaaagtagtgatcgaaccgaagaagtccctgtaatggggatggaggaatggtcacaagtcgaattgtggaaacaggcattattcaatccaatcataaggattcgagtaagaccaaaagggtcacttttctcaaacgggaggtgatgccttatgccaaaagaaaggaaaaaagtcctgtgtatggatgcccagcggcacgccgagtattacggtatgcagcagacatttgacgaactgtatgccaaaagcaaagccggagaagtattcaacggcctgatggaactggtcctaagcccggacaacatcatgctggcatacaggaatatcaaaaccaacacaggcagctacacagcaggaacagataagcagaatatcggtgacattggacggcttccaccggctgaggtcatcggtaaggtcagaaaaattgtcacaggcagcgaacacggctaccgtcccaaacaagtgcgccggaaggacatcccaaagccaaacggaaaaaccaggccgctgggtattccctgcatctgggacagattggtgcaacagtgcatcaaacaaatcctggaacccatctgtgaagctaagttcagcaacaacagctatgggttccgcccgaatcggtcagtggagcacgcaatctcccgtacttactccctgttacagcgggcgcatttacactatgttttggagtttgacatcaagggattctttgacaatgtgaaccacagcaaactaatccgacagctttggacgctgggtatccaggataagcagcttctattcgtaatcaagcggattttgaaagcgcctattcgtatgccggatggcagcacggtatatccaacaaaaggaacaccgcagggtgggattatctccccgctgctggcaaacgtggtgctgaacgaacttgaccactgggtggatagccaatgggtagaacatcccgtagcaaaccgttacggcacgcatcgaatcatccgtacttcggaggtctttgacaaaagtaaaggctaccagaaaatgcgggagacaaacctcaaggaaatgttcatcgtgcgctatgcggatgacttccgtatcttctgccgaaatcgtgaggacgcggagaaaaccacggaggctgttacaaagtggattaccgagcgactgaaactggaagtctctcccgagaaaacacgcattgtcaacgtccgtaagcgatattctgagttccttggtttcaaaatcatggtgtaccgcaagggtgaaaagtatgtcgtgaagtcccatatctgtgacaaaaagctacacttggaagaaagcaagctggtggaacaggcaaagcgcatcgcaaaaccagcccatgggcgaacgcaaccggacgaaatcggcctgtttgacgaaatggtgctgggtatccaaaactactacaggattgctacctgtatcagtctggactgccgaaaaatccaccgcagagtcatgacagtgctgaccaaccgtttgaacacggaatccggctgccagctcgcccgggagggcggtgccatgacggacagcgaaaaggagcactacggtgcttcccaaatggtgcggtatgtgtccggtatcaaccgaccaatctaccccattgcgttcatcaagtataaaaccgcaatcggtatcagcgccgccgtctgctgcttctctccgacgggacggaaaaagatacatgataatctggagatggatacgaccctgtttgcatatctgcgggagaatccgccacaaggacacagtttggaatatgctgattgcaggctctccctgctgtcagctcaaaaaggcaagtgttccgtcagcggcgagttgtttctgaatccggacaacatcgtgtgtcacatgaaagttccaaaggagcaaggtggtcacgagcgatacagcaatctggtgctgctccacaggcggtatcttcctttgctgaccgaccaagacactgccgctctcaagagcatgtgcaagcaactgactgtaacaaaaaaacaactgaccaaaatcaacagcctgcgtactgctgcaaaactggtagcaatctaaaaaaagctttctattggtgattgattaaatgcctgataacacaatcgatggaacgccggatgcggtgaaagtcgcatgtccggtgtggagtgggggaaaatctagcgattacttcaaaggattacctatcactataagcggaacgcctctattattccgcgctgatcggctacatctggtacgaggccacggaggaagaaaagaacttcatcacgcttctggaccttatcaatgccagtgaagccagagaggatgacgaaacctatcaaagcccggtggacctgcttttttctcagttggaggaacgggagccggaccactttgccgtcaagcagtaccgcaaattcaagatggcggcgggtgatatatgctctaagtgacttcttaatcatgattttgtcatggttagtgaagcaatcacttagagtatttttgtttcaggaggtacagccatgagaaatgaaaaaattaccccactgtacgagcgcctgagccgggacgatgagttacagggcgagagcaattccatatccaaccaaaagcagatgttagaggattttgcccgccggaatgggctgcccaaccctacgcactttaccgatgatggtatctcaggcacccgttttgaccgccccggatttttggcgatgatggaggaagtggaggcagggcgtgtagaggccatcgtcataaaagacatgagccgcctggggcgcgattatctgaaagtcggccaggtcatggagattttgcggcaacgcggcgtccggctgattgccatcaacgatggtgtggacagtctgaaaggcgatgatgattttacccctttccgcaacattatgaacgagttttacgcccgcgacaccagccggaaaatccactctgtgtttaagtcaaaaggcatgagcggtaagcacctgacaggcaccgtgatttacggctacttgtgggatgaaaagcgggaacattggctggtagatgaggaagccgccgaagtggtacgccgtatcttttccctcacgctggagggatatgggccttatcagatcgcttgcaagttgtccgcagaccggattgaaattcctgtcgtacaccttgcccgattcaacgaaggtgtgaaccgttcaaagccggtcaaagacccctatggatggggatcatctaccatcgtgaacattttgaaaaaacgagagtatttagggcataccatcaatttcaagacccgcaagcactttaaggacaagaaaagccactatgtttctgaggatgaatggacgatctttgagaatacccatgaagccattatcgaccagcagacctttgatttggcgcagaaaatccgcagcaatgtacggcgttatccaaacggctggggcgaagcggctcccctcacaggtttgctctattgtgccgattgtggcggaaagatgtatgtccaccgcatcaacaatggcaggcggatttctcaatatacctgttccaattataccaaagttccgtgtgggacactatgccctacacaacaccgtatcaatgagagtgctgttctgacattggtttctgacacgctccgggctatcgctgaatattccagaaatgaccggacggaatttattcacaccgttcaggaaacgcaggttgctcaacagagtgccgatatatcgaaaaagcgcaggcgtctggctgctgctcaaaagagaaccggagaactggaaaaactgatttgcaaaatctatgaggacaatgccctcggcaagctgtcggatgcacgatatagggcgcttgatgcacagtatgccaaagagcaggacgcacttgagattgaaattgcggagctggaaaaggctgttaccggctatgagcagagccagaaatccgcagagaaatttatagccctgattgataagtatgagaattttgacacgctgacaaacaccatgctcaacgagtttgtagagaaaatccttgtccacgaacgcgcccgaaaaggcagccaggacaccacgcaggaaattgaaatctacttcaattttttaggacgctatatcccaccatccttacagccggttcctttaaccccggaggaacaggaagaactgcagaaaaaagaagaacgcaaggacaggcttcatcagaattatttgaagcggaaagccagcggcgcacagaaacagtatgaggacaaaatcaaggcgaagaaaaaagcggaaatggacgctaagaaagccctgatccgggctgaggatatgaaaaaaggcgttttttctactgtcggacagctgccgaaagaagaaccacgcaaaggcagcatagcagccagcgcagcagtctaatcatcacgaagcaaaggagaatgaatatgagtaagttgacttacattcgttgtggagattatgatatacccaacctaaaactttctgaacagccggaaacttctatcggcaagtacggcagaatgcgaaaatcctacctaaaggaacatcgccccattctctacaaccatctgctgatgagcgagaagctgtatccacacctgttagagattgagcggacagcacaggggcgtgtggaaaccatgttgcctcacatgatggaagttgcgggtgtcacggaggaactgaaagcctgtgaccctatgcgctggatggggctgatgaacacgctgaaagcgcaggcagaagaaatcatattagcagaattgattaacgactgattccctaacaataaattacaatataatcaaaaagacgaagttagtgtaaatagactgacttcatcttttttgattcctatattcttctggggattttccataaactttacggaaagtggccgcaaatttacttgcattggcatagcccaaatgctctgcaatattgccgattgtcaaattcggttttgacatcaataaaagcgcataccgcatttttgcctgtcggatataagccccaataggaacaccatacatggctttgaatgattctcgaagtttggtctgtcccatcgctgctattttgcaaagctgtgagacttccggcgggttcaaaacattctgttcaatggcctgacgtacagattccagcgcctttttctcttgtttggaaagaggctgttgtttagatgctatctcctgtcgttgtttatgaaagttgcctgctacaatagaaagcagttcacctactttgctttcgtagtaaagacgggaggtttcgccagcaatcagtttatcccgtatctgcaaaaacagggttccaatttccggggtattataatcaaaagctttccaatcataaacctctgcatagtcaaaatcgtccggggtaaaacggtcttgcagatttttctctatgtaatcttcaaacagcaaaactgacgcatagctgattggtatattgggttgatataatactcgcccctgtgacggcttatttagataaaggtggattccctctgtgataggttgggctttccgcccattctggatcagggtaacaccgccggattccaaataataaattttcaccagcttttgattgatctcatatttgcgttccattgaggcgtatggtatccagcttccggttgacaggaataatccatctgtcggttgaacctgatagatatttccatagccttgtctgttttgcggctgcaaggtgcagattccattatgattatcctgtcgaaaatgataatcatgcagataaaaagaagcatcccctaattcgtgcgcggcctgtgtagaatcggtctgcatcctgctcacccccgtttcttatgtagtcggaataatccgcagtatctttttttatgctccaaaatgtcgcaaaggctgtcagcaaaaccacaaaaagcactgatatatccggttgtttttccacttttaactcctgttttgaccttttttgccggatttgacacccaaaaaatcactgagtagaatgacattactggctggttagctgactctaatcacagcaattctatcacgattttgtgcgtaggtcaatgaggcttctgccagtaaataataattaggaggactttgaaaatgtctaattcacaacaaatgaaaaaagggctgtctgtgcgtgatttgattaccaccggcatccttgctgctttgtacatggtatgcgccatgattggcgaggctatctttgggttcttccctgtactgactttcctttgcccgctgtctattgcgctgctgtgcggcccggtttatatgctgatactggcaaaggtgccgaagcatggcccaatcattgtcaccggtattttggtaggaggtgtgctgttcgtactcggtatgtactggtctatgtgtttggcatattgtattctcggcgttgtggccgatctgctggccggttccgggaactttagaaacaaagggcgtaacctgctgtcttacatgatctttgttctcagcccggttttctcctacggtatgctttggtttgaccgcgacgcctatgtgcaatatttggtagaaaagggaacagagcagacctatatggacacaatggtttcaaccgcacaaaactggatgctcccggcaatgattatcggcgtgttaatctgtgctgctatcagcggtcttgtaggccagaaactattgaaaaagcattttgaaaaggccggagtagtgtaatggagatgcaactgcaaacaaaggacacacttgccacattacatttagaccctcgcacaaaactatatctgttgatcgtcggaaatgttgcgttgttccttgcgccctctttactctatgagattgcgctggttgtatgcgttgtgattctcggcatccttgtaggagcaaagcggtttacggtaagaatggctgctgtctatgcgggaatggttgttctgcatatcattggaacaaattatttgacagggactttgcagattgcgattgtaacatttaccgtatttatccgtaaaatctttccctgtgccatgctcggaggtattttagtcagcacgacaagagtaaatgaatttatggcggccatgaaccgtattcacatgcccaaagcaatggttatccctatgacggtcatgctccgctatttccccatggtacatgaggactggggctatatcagagacgccatgcggatgcgcgatgtcgctccaaccgtcaaaagtctactgacccatccggcccgaacagtggaatgtatctatgttccgatgatgatgtcagcactgaaagtggcggatgaattgtcggcggcggctgttacaagggggctggaaaatccgaagccccgaacctgcttgcaggaaatccactttagtattgcggatgccgtatgctttctcctgttcactttgtttatgtcagtgtcggtctggctgaaattgaaagggggtgcaggctaatgattcgttttgacaaggtttcctttacctatcaggaatcattacaaaatggcggactgcgcgatgttgatttaacaatcaacaaaggtgagtgtgtgctgttgtgtgggcgaagtggctgtggaaaaaccacattgacccgtcttgtaaatggcctgattccatacttttatccgggagaagtcaccggcacaacctatgttgacggtaaagatatacaggattatcccatgtatgaagtgtccgagcatgtggggtctgtattccaaaatccacgctctcaattttttaatgtagatacagacagtgaaatctcctttggaatggaaaatctggcttatccaagggaaaaaatgaaagaacgcatttcaaagacagttgcggatttggatatagcccatttgaccgggagaagcatatttgaattgtctggcggtgaaaaacaaaaggtggcgtttgcgtccatctatgctatgtctccgagtatttacttgttagatgaaccatcttccaatctggatatggatgctattgaggatttgcggcgtacacttgaactcctaaagaaacaaggcaagaccattctaattgcagaacataggatttattatctgagggaattagttgaccgcattgtgtatatggaaaacggggctatatctgctgtgttttctccgagccagtttctttctattcctgaagaacagcggcacagtatgggacttcgcgctttagatttgtcaaaggtacagccaagggccattgctgaaaattctcaaaagccgattttggaagtcagaaacttatccttgttctataagaaaaagtcggttctggacgatttgaatttgagtgcggcgccgggagaaatcataggaattatcgggcataacggagccgggaaatctacattttccagaacactatgcggcctgcacacaaactatacggggcagattctttgggatggtaaagaactgaacgcaaagagccggttaaaacgctcctatatggtgatgcaggacgtaagctatcagttatttgccgatacattggaaaaggaatgtgtatttggaattaagcatcctgatctggacgcagcaaaacaggcaatggaacggctgggtatttatgagtaccgtactcatcatcccaatacactttccgggggtcagaagcagcgtgcggccgtggcagtcagtatggtatgccgtaaggacgttttaatttttgatgaaccgactagcggacttgattatgacagcatgattcaagttgcggggctatttcaaacgctttctaaaatgggaaaggtaatttttgttgtaacccatgattacgaatttttagcggcagcctgtacaagagtgattcatttggataacggaaaacagcaggaagattacctactttcccccgacaatctgcatcggctacgcgattttttcttgcggtcagaaaggaggcagaactttgcggagaatggaaaatgaccttctgttcttccatgagctgatcggtaactgttccgttgaaaaagattcaaagatatatacaatttctccgaaatttgggaagggcaccatgcagagttttgaagtgatgcccggtgctgaaattgtttatagtaatgtttatattacaactccaattcaaaagaatatccaatgtaaagatcgttttattgaagttacctattgctttcatgggcaaatgaatatgctgttcagcgaccagccagcgatgattatgagcgaccattatatttctgttttcaatggtgcaagccacctgaaaagctgtgattttggggaagaaccttttattggcgtttcagtggtggtttatctgccgcagatcataaacagcctgaatatcatgctggggacaatcgcgtttgacgaggacatggattttcaagggctttttacagcgggcggttgctttatagcacccgcgacaaaaagcgtggagcatatttttaccgaactgctcttgctgccggaacagtaccgcaattatcttatgcgcattaaagtcatggaactactgttatatctggttggcaaaatggaatatcggacagattttgggatttcactattccacaaggaggagatgaattgtaatggatgatgtaaaagccctgtttggactaattgataagaaaaataagcgtcgtctgcttggcgcagtaatctgttgcgtcctgtctgttttgtgcggcatcctgccctatttgggcgtttggggtattgtgacctgttttctgaatgaacggacagagaatctttttcaatatgtgtgcctgattgccgcagcaatcattttgaaacatctgctgtttggaaccggcacaaaaatctctcacaaggtagcctaccagacattgggggaaacccgtaaaaagctgttccgtaaaattgcccgcttaccaatgggctatgtgaaaacaacggcatccgggcaggtcaaaacgatcattatggacaatatggaacagttggagacattttacgcccataacattccagagattatttccggcctcgctgtaccgctgtgtatggaaatccttctggtgatattggacatcagggtaaccggtatcatgctgattccggtcgttctgtttattcttgtcggtattcttatgattatcgttcagatgaaaaaaatggacgaatttaatcaggcgtttgccgatgtcagcgttaagacggtggaatatgtcaacggtatgaaagaactgaagatatttgctgccgacgaatccacttatggccgcctgtcagaaagcatccgcacttacagcaccgttgtaacagagtggttccaaagctgcttgaaatatgttgctttcaatcataccgacttaaacagcaaccttgtgttcctgtttccgcttgccggtttgatgtacctctccggcagcgtgacagcggccagctatattatgtatctgtttatggggcttgccatgctgattccgttggaaactgtttctaataactttgattatatcggcatgaacgcctctgttgcaaaaaagatagacgaaattctgaagctggatgaaatggcggatacgacctcaaaggcagaacttgccgaccacacgattgcgtttgaacacgttacattttcctatggggaagaacagccggtattaaaagatgtctcatttactgttcctgacggaaaagtaacggcgctcgccggtgtttccggcagcggcaaaagtacagcggccagcctgatctgccggttttgggatataaccgagggacagatttgtatgggcggcgtaccgctgaaccagattccgctatccgatctgatgtcccagatttcctttgtgacccagaatacgttcctgttcaaaaagagcatccgggataacattatgatgggaaacccagaggccacggaggaagaaatgatgcaggcagccaaggatgccgtatgtcacgactttattatgcggcttccaaagggctatgacacagtgatagacaaggaaaccaagttgagcggcggtgaaaaacagagaatcacattggcaagggcgattctgaaaaatgcgccggtcgtgattcttgacgaggcaacggcttacattgatgccgacaatgaagatttactgcaaaaggcgctagctaaattatcagagggaaaaaccgtacttgtaatagcgcaccgtctttccagtatcaaggaagctgattcgattgtggttctggaacagggcaaagtgattgactgcggcacacatgatgaattgataaaccgttgctccccgtatcaggatatgtgggcggcctttgaacaatccgatcaatggaaaatgggaggtgtaaacgcatgattgctatgataaggaaattcttagaccttgcaggcgagcgcaaaaagcagctttatcttgcgtggctgtttcaggcgttgacctcaatttgtgagggcgcgatatatttcatgctgttccttgcgataaaagatattttgggcggctcgtttacaaaggaaaaactgatgcagtatagccttatgtttctggtctatactgtcctgcattttgttttttattactttacgattgcaaaacagcgcccggtatcttatgccatgatgcgggatgaacgtctttcgattgcggcgaaaatcaaacagtttccgctctactactttacaaaagacaagatcagccagcttacatctttgtttacaactgatttaagtttcgtggaaatgaatatcatggagattattgccggtttcgtttccagcatgatcatgacggttgtatttgctctgatgctgcttagtgtggactggcgtatggcgcttcttctgtttgcggggatcatccccggctatatcctctaccagcagtttcaaaagagcatggttcaactgggagagcagaagaaaaatacgcaggtggcaatgattgattccacgctggaatatgtacagggcatggaaacgatcaaggcataccggctggagcaatccggtaagctcgtggagaagcaggtgaacggatattgcacggcttctgaccgttatgaagcgacgctgacgaattggagcatgggttataaaatctgcctgaatctgggcctgtttttgagtttgggtgttggcattgcaatggttcgttctggttcattagccccggcaacctatttgttttttgcaatcatgggtattattttttaccgtccgctggaagctctgatgggttcctttgccatgatgaatcttgcaaacgcatcgttggataatatagcagaaatcaacaacctgccgaccgaaaatgaaaaacagggaactacacagtttgcagatacacaagccgatgtacggtttgaaaatgtatcgtttagctatgatggaaagcgtgacgcagttagtcatgtaagtttttcagctaaacccggaacgatcactgcattggtgggtccttctggaagcggcaaatccactctccttaatttaattccgggattcgtgacgccgaaaaacgggcggattctgttgaattggaaagatgcggcaacattaaagcatagtgatctggtgcgtcatgtgagtgtcgtttttcaggaagtatatctttttcaggataccatgatgaataatatccgaatgggaaaccagagcgcaacggacgagcaggtggtagaggcggcaaaaaaggctcactgtcacgaatttatagaaaagctcccacagggctatcaaacggttatcagcgagggcggcgcaagcctttccggtggagagcgtcagcgcgtcgctattgcgagggcaattttgaaagattccccgatcattcttttagatgaggcgctgtccagtctggatgccgaaaatgccgtagcaatacagaagggcatagaagaaatgattaagggcaagacggtgttccttgtatcacacactttgtcctatatccaaaattcagatcagatacttgtcctatctgacggcatattgcaaggctgtgggaaacatgaagaactgttgcagaccgtgccgctttatcaaactatgtgggaaaaagagaaatctattaaaaactggaagctggcataatgagcagcaagaacaaacttcatgcgtccggggaggactacctggaaaccatccttgttctccaaaagaaacgcggtatggtacgctccgtagatgtggcccggcacatggaggtgtcaaagcccagcgtgtgccatgcagtggctatcttgcgggacggcggctttctcactatggacgaagatcactttctccatctgaccgatgtgggccgcgaggtagccgaaaaaatctacgagcgtcactgcttctttaccgagcagcttatcgccgcaggcgttgaccccaggactgcggaggctgacgcctgccggattgaacacatcatcagcgatgagagcttttcacggctgaaagaggcagccgaacaggaacaaacctaaaccaaataagacaagcgatcctgccccgcaagacggggaaagaaaaaaaccgttgcagggcaggcagctttgtgcgcccaaaatggattttccaggtactgcggcggttttgagtaacatcaaggccgccgttccttatgccctcgacaaaggagtgacgactacacgctgacacggcggctttaggagggaaccgccatgaagcacattgaccgccgacaaattcagacgatatttcactaccgtcaaaaaaagcccagtcaacgaacaggctccgtctggcagccggtgcgaaaattgtcattctgtaagtgaatattggagtttttgcgctcgaatagctttctgctgtccgggcgttttttcatacctgtggggccgtaacatcgggccagcatggcccgaactctggccccagtgccgttctccgccgccccattcagatttaccaaaaaaatctgaatggaggaaaggcagatggaagttaccatcaattataacggacaagctgtggccgtggaggttacgctggaagtctatgaatttcttgaccgggccgatcataaaacggagaacctgttccatgaacagcggcggcattgggacgggcgggagtttgacgagtacatagcttttaccgagggcgtgggcgtttacagtgaaacgccggaggaatacctttgccgcatggaaacgctgcatgagctgatggctgttctggacacctgtaccgaggcccagcgccgccggttcctgctctatgcgcttgacgggctgagccttgcagagatcggtgtgctgtgcggctgctccaaagtggctgtttatcaaagtgtggaggcggtcagaaaaaaatttataaatttctttgagaacaggcttaacgaatgacctgttttcgggctatcaagtgaaagggatcatttcccttatctcagcgagaggcggacagcggacaagctgcccgcctctccgattttcaggaggtaagcctatgaaaacaatcaatctgcggtggatgtatccccactaccggcatgacgagtttgtagaggtcagcgacgaggtctgggaggccatgcggcaggcccagcgcgagatgaacaactatgagcgccggaaggtctaccaccgcgcctggtactccctggacgcatatagctggacggagaactacgcgctggaacacggcagatcgccggaggatattctggtggagcgtgaggaacgggccgcccgcctgcggctggttgccgccttgccggtggctctggctcatgccactccgacacaggcccgctgtgttcacgcctactacattgctggtatcaagcagccggaaatctcccggagagagggcatccacagcagcaaggtcagcgttgccatccgtcgaggtctgcggaatatgcgccgctgctatgatggcctttttcaaacagagtgagggcgtgcctatgcagaccatcaatctcaaacaatattatccattttgcaaagaggacatttttgtggaggtgtccgatgagatcgtcgaagcgtttcttctggacaagagagccgaggccgccagagatcgcaagatgttccggtataaggcgttttattccctcgattgtaacgatggaatcgaaaatgccgccatcggctgggcgcagccatcgccggaagactacctgatagaaaaagaagaattagccgaatacgaagaattgatacggcgattgtacgaagccatttcttccctgccgcctatgcaggctcgccgtgtccatgcccgctatatgctgggtatgaaagtgaaagatattgccgcaatggatggtatcacaccatcacaggcgggaaaatccatccacgctgcactgcggaggctgcgccggtactttgctcgacagaaatggacggtcaatctatgagtattttcaaagaaaagaggtgcctgacatgaacgaaaaaattacagcccacccctcaaaagaagaacgggagaaagtcctgaaggagatccggcagcttgaaaaccgaaagaagattttggagaacaagcagcggaacgaagaacgcagggttcgtacccgccgcctgattgagcgcggagccattttggagggtatttttccgctggcctccaacctttccggcgcagaggtcaaaacatttctgattgccctgtcccatcttccgggggctgcggaattgactgcaaacctgccaaaatccggggacacgccataagtcccttgtttacaagggcgcacttatacaccgttgccggtgtcgtgcgccctgccggggctgttgcgtacttcgtccgcgatgggaagctacgctccccaaaccccttgtgcgctctgcacagccaaacacccgctttgcgtttgttcggctccacagagcctattatcccctcactgaaaggaggtgttccccatagatttctgtcatatccccgtcagtattatcaagcgcagcgcaggccgttctgccgttgccgcagctgcttaccgcagcggaaccaagctgacaaatgaatgggacggaatgacccacgactacacccggaaaggcggcattgttcatgcggagatcatgctgcctgcccacgccccgccggaatttgcagaccgatccaccctctggaacagcgtggagcaaattgagaaagcaagggacagccagcttgcccgcgagattgaggcagctctgccccgcgaactgtccagagaacagcagcttgcccttgtccggtcctatgtgaaggacaactttgtggacaaggggatgtgcgccgattttgctatccatgacaagggaaccggcaaccctcatgtccatatcatgctgacgctccggcctctgaaagaaaatggacagtggggcgcaaagtgccgcaaggcatacgatctggacgagaatggacagcgtatcccggatgggaaaggcggctggaaaaatcatcgtgaggatacaaccgattggaacgataaaggaaatgtggagatttggcgggcagcgtgggcagcctacaccaaccgggcgctggaatctgccggtagaccggagcgcattgaccaccgtagctacaagcggcagggcattgataaaatcccctctgtccatctggggccagctgccagccaaatggaaaatcgcggtatccgcaccgacaagggggaagtaaaccgacagatcgccgccgacaacaaactgctgaaagaaattaaagcccgcattacccgtctttatcgctggtcgaaagccgaaacggaaaaaccacaaacacagcaaagcagcttgacagctttgtgggaggctcagcagcagttgaacgctccccacacccgcaccggcaaaatccgggctttgcaggaaagcgctgcactattcagctttttgcaggcaaacggcatccagtctatgcagcagcttcatgaaaaaatcgctgatatgaacagccgttactatgacctgcgcggaaagatcgtcaaggctgagcgccggatcgccattcttaccgaacgcggggagatgtgggaacagtacaaccagtacaagtccatccacaagcagcttgccaaagtaaagccggaaaaacgggaacagtttgaacagcgccacagccgggaactgattctgtatgatgcagcggcccggtatctgaaagaactgaaagacagcggcgaggcaatcaccccaaaggcatggcagcgggaaatcgaccagctggccgctggaaagcagacggacacgcttgccatgaaatccatgcgggaggatttgaaagcagtggaacggctccgcaaaaccgccgagcagctgtccagacaggaacgggacaagtctcacgatcgggagccggagcggtaagggctaccgcgtttcacgacatacttttgcacacagaaaaaccgccgtacaggtttccccatacggcggcagactgtttatttgccgaacaagtcgctgtgtgtgccggtgcgggccagcgtcagcaccagaacatcatcttctatgcggtagacaagcagccagtccgggagaatgtgacattcccgatggcctgcccaatcgccggacaggtcatggtcacggttcttatctggcagcggttcgcccatcgccagcaacgctacgacctgctccagcagctcgatcttcaagccacgcttgatggctcgtttgtagtcttttttgaaactggtcgtgtacttgacggtatatttggtttctttcatcttttcaggtcagcaaataactcgtcaaggtcattgtagccctttacagacgggtcttttgcaatcctttccgcttccagcatggcagcaaccgtttccttgttcggctgttccagccttacttcaaagggaatgccgccttcacgaagcgactggcgcacaaagatgttaaacgccgtagtcaggttcatgccaagttcagtaaacagtgcgtccgcttgcgctttcaaatctgcgtccatgcggatactgatgtttgtggtatttccagccatacgatcaacccctttctgctgacaattatagtatatgccatttgcacgaagaaaacaatactttgcacgaatatttaacaataaattcattcaaggaggttaccggctttatgaaagaaatcatttatgaagaacaacaagactgaacctatccctgtcatggattaccgccagtatcgcagagcgcggaggctggtgcatgagtgctgtaactacatcgacggaaactgtatcgccctggacgatggggaggaatgtgtctgtgtccagtctatttcctactccctgttgtgcaggtggtttcgggcggcggtattgccgcaggataaggaactggaaacggcgctgttccaccggctgaatgctaagaaatgtgccgtatgcggggcgctgtttactcccggctccaaccgagccaaatactgccaggaatgtgccgcgtgcatgaagcggatcaacgccgcaaagcgcaagcggaaacaacgggagaaatgtcacgctttaggggccgaaagacccttgtaaatcaaggcttttttcgagggtgtcaacggtaagctgatagatttatcctctgacccctaaaacggccttaaaatgcgtacagaatcccaagagaaaccccaaggaggaaccctatgtcagacaaccgaaaatattattacctgaaactcaaagaaaactattttgacgatgattccatcgtgctgctggaaagtatgcaggatggtgtgctatattccaacattctgctcaagctgtatctgaaatcgctgaaacatggtggacggcttcaacttgacgaggacattccttacacggcgcagatgatcgccaccattacccgccagcagatcggcactgtggagagagccttgcagatctttttgaagctgggtcttgtggaagtgctggacagcggcacattctacatgagcaacatcgaacttttaataggccagtcctctaccgaggccgagcgaaagcgggctgcaaggcttcaaaataaggctctttctgcgccccggacaaacggcggacatttgtccgacattcgtccaccagagatagagatagagttagagaaagagatagagataaagagagagatagagaagggacgctccgcccgcgcctatggccgttaccagaatgttttcctgacggacgaggaactggcagacttgcaggccagctttcccaccgtatggggccagtacatcgaaaagctgtccgagtacatggcctctaccggcaagcggtatcagagccatgccgcgaccatccggcgctgggccggtgaggacgcgaagaaagcagccccgcccacccgcaaccgggattacagcgtaaaggaggatgaaaccgtatgatggagattaccgcagaaatccgggcgctgatcgacaaggcagccgccggtatggaactggccggggacgagtacatagacccggcagacggcctcattcactgtaaaaagtgcggcggccagaggcagaccgttgtgccatgctttgggaaacccgactactttatgccgcgctgcatctgccagtgccagcgggaggctgaggagcagcgtaaggccgccgaggaacggcagcgccgcatggagcgtatcaaacgccgaaaggcacagggcttgcaagaccgctatctctatgactacacctttgccaacgacaacggcaaaaacccattgatggacaaggcccgcgcctatgtggagaactggaaggaggcatataaaaacaacaccggcctgctgttgttcggggatgtgggaaccggcaagtcttttttcgccggatgtattgccaatgccttacttgaccaggatgtgcctgtgctgatgacgaacttccccaccatcctgaaccgcctgaccgggatgttttccgaggacaaggccgactttatcgccagctttgacgagtacgacctgcttatcattgacgatctgggtgtagagcgcagtaccgaatatgctatggagcagatgtttttcgtcatcgacagccgctatcgcagccgcaggcccatgattatcacaacaaacttgaaactgtccgagctgaaaaacccgcctgatctggcccacgcccgtatctatgaccgtattctggaacggtgtgcgccgattctctttgacgggaagaatttccgggaagaaaatgccggtgctacccgacagacagcaaaagacattgtaaacagtaagcacgactgattttttaccgggcggcacagacccgctcaaagaaaggagcgccatgaacaaagaaccccgtactatgcaggcggcagacgccgctactgtgtccagagcgccggaaaacacgccagcgatggtaaagaaaatcggcaagacaacctacaaggttcatgtccatttcagcaataccagcacagaaaccatgagcgataaaatcaagcgtatgctcaaaaatgaaattcagcagatgtgacagactgataaacgaagccgccttgtgctaaactgatgatggtacgcaccaaaatttttgtcaaggaggacacgaaaatgctttacacagaaaaagagaagcatgaaattgaacgagtaaaggagatctttgcggaacatctgcggcaaagccctgattttgaactgctctggtcggacaaggtaggctatgtctggctggcgattggcgtcaatccagtctatgtggataccggtatcagaatcgaatcagccgccgatctctgcggcaggtgtttggatgatgttgctacggatgttttatatatgacaggcaacgatcatgcactggaagcagccgatccgctggaattggccgaaatcaagcggcgctgggagccatatatcaaccagctgccagactatgcgtatctctgcaaagacctgctgaacggaaaaatgtaatctatcaaacgaggtgtcaggagccatacggtgcttctggcaccttttttgtggattttttgtgaatttgatgaaaaagtccttgacaatttgtctctggcaagaccttgaaatccatcctcatttcctgcggtgcccggcttgctcccttcgatatcaaggagctgcgggacctgatggagtatgacgaactggaactggataccctgggcgaccaaaagacggcattgtttgtgatcctgtcggatacggacagcactttcaatttcgtggccgccctcatgtatagtcagcttttcaatctgctctgcgacaaggcggatgacttctacggcgggcggctgcccgtccatgtgcggctcattctcgacgagtttgccaacatcggccagataccgaactttgataagctgatcgccaccatccgaagccgtgaaatatcggcttctattattttgcagtcgcagagtcagttaaagaccatctacaaggatgcggcagataccattgtcggtaactgtgacagcaccttgtttttgggaggcaaggagaaatccaccctcaaggaaatttcggagctgctggggaaagagaccattgatctctataaccagtccgaaaaccggggcagtcaggtttcccatggcctcagttatcagaaattaggaaaggagttgatgacccaggacgaattggcagtgatggacggcggcaagtgtatcttcatgctgcgaggcgtgcgtccgttcctttcggacaagtacgacctcacccggcacccgaattacagatacacggccgacgccgaccctaaaaatgtctttgacatggaacggtacatgaagaagcagcgtgccgtggtaaaacccacggacaccttcgatgtgtacgagattgacgcaactacttaaacccaaatcaaaaacattttttaggaggattattttatggaatttttcaacagcgcagttggtgttttgcagactctcgtagtggccctgggcgcaggtcttggtatctggggcgttatcaaccttctggaaggttacggtcaggacaaccctgcttccaatgctcatgtacggtaaagtatcacaagaaaattatgtcgaattgacagccgcctccgctataccgaataaggaaataaagagtcctcaaattttgcgctactaaatgaagacgagcggaagtaatctcccgctcgtcagtaaacttaactatgccatatcaatcccgcttctttcccgccaccggcactaagaacagcgcgggcaacagcaggaaagcggtacagaccagcccccagggtatggacacctgctgggctaccagccccacaataggcccgccgatgatctgcccgaaagagtccagctgtccgctggtggaaaagactgtggcgcgcattttctcatccacatggtcgttcatccaggcggccagcacaggctccttgatggtgcgcataagccccgccagcaggaacaccaacaacatgaaccaaaagctccgccccaccgcgaagagaaccaggcacaggatatacccggcgctggtggacatgaccacactggttcggctgacagtcccttttttctccatgcgggcgatgagcaactgagaagccagaatacctaagccgctgccgataagactgataacaccgaaccaagtgacgctgttcagcggcccgataacgggtattaccgtgtcatccagaaaatgagcggtggagagccggtcaaagccttcactggcaagtcccccgcatagtgtgattgctaagagcgccagcaacacaggtgcgcctttcacaaagcccaggttgagcttgaacaggcagacaaagtctttaagcaagccctgccgttcctcaatagcaggggagaagttggtttctggcatgatgcgaaccaacaccagccccaacaacaagcacaaactgccccccaagatgacaggcatttgcaggtttatgtttcccagcagtgtgcccagcaccacgcccagaacgccgccgatttgccccatttgactgccccgcaggaacaccttgtctatgggtttgtcctcttcctccgaggcaatccacgcctccagagcgccggtgatgaaggtatcaccgcaaccccagacaacctgggccagcagaaccggcgcgaaccacggtagcgcaccctccatcagaaagcccaggccgtagaggaacattccaatcagcaccgagcgccgacggctatacaaatccgccaccacaccggtgggtatctcgaacagaaagcaggaggtctccagaaccgtccctaccaggacaagctggaaagcatccagctgcaccacctccaggtggtacacgatggaaagcactgtggacatagaaaccgccagggaacagacaaatcggaacagcaggtagacagaatatgcctttgaatttttagcaaacatgaagttacattctcctttactgaaattagaacaacatggctgttcttcttcgcgatattatagcaaatgggctttgtgttgtcaatgtaaagagaagcgagagcgagagcgagagcgagagcgagagcgagagcgagagcgagagcgagagcgagagcgagagcgagagcaagtttctaccacggtgccaaaatccgcaattctgcggttttgcccctcgcgggaaacttgttggggagtgccttccccaaaccctgctatgcggcttgcgccgcttatccccgccgcgctcatgcggcaagaaaggaggtcacgaccatgcgaaagaaatacaacacaccccaccgcagccgcgttgtgaaaacccggctgtccgaagatgaatacgccgacttcacagcgcggcttgcgccctatggtatcagccagtcggaatttctccggcaggcgatacggcgcacgaccatacgccccgttatccatgtgtcagcggtcaatgatgaactgctttccgctgttggaaagctggccgccgagtacggcaggatcggcggcaatctcaatcagattgcccggtatctgaacgagtacggcgcaccttacaatgcgctgtccggcgaggtgcgcgctgccatagccgaccttgccgccctcaagtatgaagtcctcaagaaagtaggtgacgcggttggcaacactcaagcatatcaactctaaaaatgccgactacggagccgccgagcaatacctgctttttgagcatgacgagtttaccatgaagcccgtccttgatgaaaccggcaggcttatcccccgcgaggactaccggctgtccacactgaactgcgacggggaggattttgccgttgcgtgtatgcgggcaaatctccgatacggaaagaaccagcagcgggaagatgtaaaaagccaccactatatcatcagctttgacccacgggacggcccggacaatggcttgaccgtagaccgggcgcaggcattgggggagcaattctgtaaagagcatttccccggccaccaagcccttgtatgcacccacccggacgggcataaccacagcggcaacattcatgtgcatatcgttatcaattcgctgcggatagaggaagtgccgttcctgccctatatggacaggccagccgatacaaaggccggttgcaagcaccgctgtaccgacgcagccttgcgctacttcaagtccgaagtcatggagatgtgccaccgggaggggctttaccaaatcgacctcttgaacggcagtaagaaccgcgtgaccgaccgggagtattgggcgcagaaaaaaggacaggccaagctggacaggcagaacgcccccatgattgcaggcggtatcacgccccggcagaccaagtttgaaacgaacaaagagaagctgcggcagaccatacggaaagcccttgccaccgccgccagctttgacgaattttcctctctgctgctgcgggagggcgtgagcgttaaggagagccgtgggcggctttcctacctcacgccggacaggacgaagcccattaccgcccggaagctgggcgacgactttgaccgcgccgctgtctttgccgttttggagcagaacgccgccagagccacagaaaaggccgcagccatacccgaatacccccggcatgggaaaaccggcatacagcctacaaaagccccacaaaccgccccgaaactcgtcggcgcaagctccatatccttcgcttccccgcaagcgggaaagctcactcattccgctgcttctcctctccccgcaaagccagacggctttgcgggggccccaagtgtgcagcggcttgtggacattgaaaagaagctggccgagggcaaaggccggggctatgaacactgggcgaagatacacaatctgaagcaggcagccaagacgctgaatgtgtatcaggaatacggctttacttccccggagcagttagaagccgctgttgataccgcctatcaggaaatgcgccagaccagcggcgaactgaaagcactggaaaccaagctacaagggaaaaaggagttgcagcaacaggtacttgcctatgccaagaccaagcccgcccgtgacgggctgcgggcgcagaaatcgcagaaagcccgtgacgcataccggcaggcaaacgagagcgattttatcatagccgacgcagccgcccggtatttcaaggcgcatggcattaccaagctgcccgcccggaaagcgttgcaggccgagatcgagcagcttatctccgagaaagacggcctgtataacacctatcacgaacagaaacagcggttcaaggagttgcagaccgtcaagcggaacatcgaccagattttgcgccggaacgagccgcaccgcagaaaggagcagagccatgagcgataagttaccgagaatggactaccgccagcatcggcgggcgcggcggctggtacatgagtgttgtaactacgacgagggaaactgcctgctgttagacgacggggagccttgcgtgtgcgtccagagcatttccctttccctcatgtgccgctggttccgtgtggctgttctgccccttgacggggaactggccgcagccctcttgcaccgagggagccggaaacgctgcgccgtctgcggggcggcatttgtccccaaatccaaccgggggaaatactgtcccggctgcgccggacgcatgaagaaaatcaaagccgccgagagaaagcggaaacaaaggcagaaatgtcacgctttagagcctttcaaacccgcataaatcaaggcttttttcgtgggtgtcaaagggtacgcgatacatttatccttttccaccggaaacgccgttctaaggcgtgacaaaacgccaaaatcaacccgaaacacagggaggtgatactatcgctgattatatcatggcagacacgccgctgcctatctatctgccctacccccgtttcctgctgaaaatggagatttcccagaccgccaagctgctgtattcgctgctgttagaccgttccacactttcccagaagaacaagtggcaggacgacgagggcaggatatatattatctatcccatcgcggagatagccgaaatactggataagggcagcaccaccataaagggggcgcttaatgaactggacatggcggggctgctggaacgggaacggggcggcttctccgcaccgaaccgcctatatgtgaaagtgccgcgtgtgccacaggtacagttttccgaccaactgatggccggaaatccgaccctcatagagccggaaaaccgtcctactgatggtcagaaaaccgaccttatgatggtcggaaaaccgtcccctaaccaaactactataaacaaccttacagagagccaaacaatgggagtgagtggggagccgcccgcgccctatggccgataccagaatatttttctgtcgcagaccgaatacgacgagttgcaggcagagtaccccgacaggttggaacggttcatcgaggaaatgagccgctaccttgccgccaacgggaaaagttatcagaactatgccgccgccctgcggatatgggcggggaacgacaaaaagaaagccccgaaaaagggcataccagactactcatgcaaggagggcgagagtttatgaagaacgaaatcaacgctgttttggagaatatgacggccaccaccccggagccggaggactacaccggcgaggacggtttactgtactgcggcaagtgccgcaagccgaaagaagcctattttgcgccggataaggctgctatctttggccgtgaccgccacccggcagagtgcgactgtcagagagccgcccgcgaggaacgggaggccgcagagaagcggcgcaggcaccttgacaccgtggaggaactgaaacgccggggctttaccgaccccaccatgcgggactggacttttgagaacgacaacggcagaaatccgcaggccgggattgcccgccggtatgtggaacactgggaggatatgcgagccgacaatatcggctgcctgttctggggcggcgtgggaaccgggaaaagctaccttgcgggctgtattgcaaacgccctcatggagaaagaaatccccgtccacatgacgaactttgcccttatcctcaacgaccttgccgccagctttgagaaccgcaacgagtacatttcccgcctttgccgctatccgctgcttatccttgacgacttcggcatggagcgcggcaccgagtatggattggaacaggttttcaatgtgattgacagccgttaccgtagcggcaagccgctgatcgtcacgaccaacctcacgctggacgacctgcggaacccggaggacaccgcccattcccggatttatgaccgcctgctttccatgtgcgtcccggtacgctttaccggcgacaacttccggcaggaaaccgcgcagcggaaaatggagagcatgaagaaactgattaccgactgaaaggagtattgcctatggcagatagacagcagcacgacacccgcaccacccgccgccccgactgcgtgacggaaatccgcatgggcaattccgtccttgtcgtgtccggctatttcaagaaagacaccacgaccaccgccgccgacaaaatggcgcgggtactggaagcggaagccgctgctacacaaaaatcggcaatttgacaaatcataaagaagctgattttacacttttgccgctatacagcccgccctattccgtggtacaatgaaaccacggaatagtggggctggctgtcggaaacggaggattttatgttaagacaagccacccaaaacctcattaccgccctttatccgagattgtcccatgaggacgaattgcaaggcgagagcaattccatatcgaaccagaaaaggattttggaaacctacgccaagcagaacggctttaccaatctgcgctggtacaccgacgacggcttctccggcgcaaactttcaaagacccggttttcaagccatgcttgcagacattgaagccgggaaagtgggtacggtcatagtcaaggacatgagccggttagggcgaaactacttgcaggtagggttttacacggaaatgctgttcccccaaaagggagtgcgttttatcgctgtcaacgacaatgtggacagcgcaaacggcggcatggacaacgattttacccctctgcgaaatctgttcaatgaatggctggtgagagatacgagcaagaaaatcaaggcagtaaaacgagcaaaaggcatgagcggcaagcctgttaccagcaagccggtctatggctacctcatggacgaggacgagaactatatcgttgacgaggaaaccgcgccggttgtccagcagatataccagctttgccttgccgggaacggaccgaccaagattgcccgtatgcttacggagcagcaaatccccacgccggggacgctggaataccgcaggacgggcagcacccgccgctaccaccccggctatgagtgcaagtgggcgacgaacaccgtcgtgcatatcctcgaaaaccgggagtacaccggctgtctggtgaacttcaagacggagaagccctcttacaaggtcaagcacagtgtagagaaccccgtggagaagcaggccatttttgagaaccaccatgagcctatcatagaccgggaaacatgggagcgcgtgcaggagttacgcaagcaacgcaaacgcccgaaccgctatgatgaagtggggctgttctccggtatgctgttctgcgccgactgcggccatgtgatgtaccagcagcggtatcagaacaaaacccgcaagcaggactgttacatctgcggcagctacaagaagcgcacccgcgactgtacggcgcactttatccgcaccgacctgttgaccgccggtgtcctctccaatctccggcaagtaacggaatatgccgccaagcatgagagccgctttgtgaagctgcttatccagcagaacgagatcggcggcaagagaaagaccgccgcagccaccaagcagcttgaacaggcgcaggagcgcattgccgaagtgagccgcattatcaagcggctgtatgaggacaatgtaaacggcaaaatcagcgacgagcgtttcatggaactgtcggcagactatgagcaggagcagcgggaactgaaagaccgcgccgccgctttgcaggccgaactggacaagtcgcaggccgccaccgtcaacgcggaaaagtttatgggtatcgtccgaaagcaccttgcctttgaggaattgacccccaccctcttgcgggaaatgattgaaaaaatcgtcgtgcatgagtgcagctatgacgagaacggcacccgcaggcaggacattgagatttattacagctttgtcggcaagattgacttgcccgaagcctaacgcccgacctatccgacacaatggccaagtgccggataggaacggcaaaattttttacacttctattacttctttatcgcacataagcaaaaagccagggtatgaaacagttgatggccggcggcggtgtcgccctcatcggcatcacccttgtacctctgctctccggcctgttcggttgatcgtccggcggtgatcgcttatgggcggcatactcgacaagctcgatgaatggctccgagggctgcttatcgagggaatcacgggaaacctgtcgggcatgttcgatacggtcaataccaaagtaggcgagatcgccggtgaagtgggacagacgccgctggcatggaacagcggcgtcttttctatgatccgaaacctctctgaaacggtgatcgttccaatcgccggggttatcctgacattcgtaatgtgttatgagctgatccagcttgtgacagagaaaaacaatctgcacgatgtagatacctggatgttcttcaagtggattttcaagaccttctgtgccgttctcattgtgacgaacacatggaatatcgtcatgggtatctttgatgtggggcaaagcgttgtgaacagcagcgcaggcgtcatcatcgggaatacctccattgatatcagcagcgttatcacggatatggaggcgcagcttgaagccctgggcacgggagaattgttcgggctgtggttccagtcccttttcgtggggcttaccatgaacgccctttccatctgtatcatgcttgtcatttacggccgcatgattgaggtgtatttgacaacttccgttggaccgatcccgcttgccactatgacgaaccgggattggagccatacaggacagaactacttgaaatccctgtttgcattggcgttccaggcatttctaatcatggtgtgcgtgggaatctactctgttttggtacagagtatcgccacggatggaaatatctcaggcgcgatatgggcctgcatgggctacacggtcctgctgtgcttcgccctgttcaagaccggcagcctctctaagagcctgttcggagcgcattaaggaggcttgataaattggcgtatgtaaccatcccaaaggatttgacgaaagtaaaatccaaagtgctgtttgggcttaccaaacggcagcttatatgtttcggagcggcggcactcattggagtaccgcttttctttttgctcagacgcacggccagcaacagcgccgccgcgttctgcatgattatcgtcatgctcccgttctttctgcttgccatgtatgagcggcacggccaacccctggaagtggtggccggacaggtcatccgctgtatgttcctgcggacgaaagagcggccttaccagacaaacaatttctacgcagccttggagcggcaggcccaggcggaaaaggaggtgaaagccattgttcagaaagcgaaagcaagagccgcaggcacggcaggcggcaaaacccgcggtaaagctgaccgccgcagaaaagcgtgagatcagccgtattctggaaactgccagaggcgacggcaaggtacattccgcacaggacaccttaccgttccgccagatgtacccggacggtctgtgcaagctggacgaccacacctggtcgaagtgtattgagttcgaggatgtgaattatcagcttgcaaagcctgacgaccagacggcgatctttgaagccctctgcgatatgtataacgcccatgacgcttctatcgggatgcagctctcccttgtgagccgccgcatgaaccgggaggattttgtgaagcgtatcgagatcgcagcgcagggagatcacttcgaccatatccgtgagctttacacgcaaatgctccgcaagcagcttgaacggggcaacaacggtcttatcaaaacaaagtatctgaccctcaccatcgaggcacgggacagcaaaaccgcacgggcacgattttcccggatcgtcatggacgcccttaaccatttcaaggtcatgggtgctttggcaaaggagcttggcggcaaggagtggctggaaatgctccacggcatcctgcacccggacggggaacggtttgcctttgaatggagctggcttgccccttccggcctgtcggtccaggattttgtcgcaccttcttctttccgcttcggtgaagcacggaagttcacaatggcagataaattctgcgccgtgtcctttctgcagatcagcgcgccggaaatggatgaccgtatgctcaccgagctgctggatacggacagcgggctgcttgtcagcctccatatccgcagcatggatcagaacgaggcgatcaagacggtcaagcggaagatcactgacattgacagtatgaagatcgacgcgcagaaaaaggcggtgcgagaaggtttcgatatggatatcatccccactgacctcgccacctacgcaggcgaggcaaagaacatcctccgtgatctgcaaagccggaatgagcgaatgttcctgatgaccttcctggtggtgaatttttcggacagcaagcaaaaactggagaatgaccttctccgtgcggcaagcgtggcgcagaaatataactgctccctggtgcggctggactttcagcaggaggacggtttcgtatcggctctgcccctgggtgtcaaccgcattaagatacagcgcggacttaccacttcggcggtggcggtgttcgttcccttcaccacacaggagattttccacggcggcgaagctctttactacgggctcaatgccacttccggcaatatgatccttgccgaccgcaaaaagctgaaaacgcccaacggcatgatcttaggtacgcccggcagcggcaagagtttttctgcaaagcgttccatcgtgggtgtgttcctaaacacaaaggacgatatcctgatctgcgacccggaggcggaatattttccactggtgaaccgtctggaaggacaggtcatcaaaatctcacctaccagcacacagtatgtgaatcctatggatatcaatctcaattatagcgaggacgataacccgctggcgctgaaatccgactttatcctgtcattctgcgaactggcggcaggcggacggaacggtctggagccggtggagaaaacggtcattgaccgtgctgtgcggatcgtgtaccgcccctatattgcagacccccgcccggagaatatgccgctgctggaagatttgtatgacgagatcaaacggcagccggagccggaggcgcagcggatcgcggcggcactggaactgtatgtgcatggcagcctgaatgtttttaaccaccgcaccaatgtggatatcaacaaccgcattgtctgcttcgatatcaaggagctgggaaagcagctcaaaagcctgggtatgctggtgatccaggatcaggtgtggaaccgtgtttcccaaaaccgggatcagggcaaatccacctggtacttcgtggacgagttccaccttctgctgcggggcgaggttggttcctggagtgtagagatttggaaacgctttcgcaaatggggcggtatccccacggggatcacgcagaacattaaggacctgctttcctccccagagatcgagaatatctttgaaaacagcgattttgtgtaccttctgaaccaggccagcggagacagaaaaatcctctgtgagcgtctgaatatctccaaccagcaggcggcacatatcagcaacgcaggcccaggcgaggggctgatcttcttcggcaatgtgatcctgccttttgcggatgacttcccgaaggacaatgaactttacagcattatgacgacaaaacttggtgaaaccgggaaaggagaaaacgaacatgaatgatccccgctatttgcatacggaagaaaaacaggagggcgaaaccttctttgatgtgatgaatcggctgattgccagaagcaaggcggtcacggcggatatggaggcggtccttgcggagctggaaagtgagatcgaaccgttccgtgcgccgaagggccatgaataaactgacccatgtgagcctgttttccggcattggcggtctggacctggcggcggaggctgccgggtttgaaaccgtctgccagtgtgagtgggcggattttccgcactccgtcctctccgcacgatggccggatgttcccaggttccgggatatcactactttcacgaaggaggcgttttttgaaaaaacaggacttgaaacagttaccgttatctcaggcggctttccctgtcagcccttctccaccgccggaaaacggaagggctttgcggatgaacgctacctgtggccggaaatgtgccgcgttattaccgagctgcggccccgttgggtgcttggggaaaatgttgctggcttcatcaatatggggctcgacaaaacgatctttgacctggcaaaagcgggatacgctgttctcccattcgtatttccggcttgcggtgtcggcgcatggcatgagcgccagcgaacttttatcgtcgcggctgatgtttcccacaccccttgcctccgacaacaacaccgccagggacgcggcaagcctggatgtgttcctgtcggacaatgggatattccgcaagaggaaccgaaacggggcgatttggagcctgagcctgtcggcggcggtattctatctgaccccggtggcgtcggacggtttccgctcgaccttgaagccgtcggccttcgatccgacgaagaaggacgggaacctgtcggcgcagatcatctcccaggaacagccggtgtccgaaacggcggcgctgaacccggattgggtggaatggctcatgggcttcccgaaaggatggacggacgtatcctctgggccgacgagccggaaggaatcccccgcatgaccgagcgcatggatgacagggcgctgcggctgaaaactttgggaaatgcggtctgcccgccccaggcctatcccattttccgctatatcgccatgatcgagaatggcacctgcggtgacttctgcccctatggaaaggaaggtgactgcctatgagggaactgaaagcgaccgataagatcacgcagaaaatgacccgtgacggtgcggtatcggaaaaccttgccacgggcgaggtggaacatatcagcagccgggagccggaaacggaactgtccgcttcttcggaagaatccgctggcgctgcggctgatcttgccctgcgtgcggcggaacgccatgagaggaaagccgcacgaaaagcggaaaaggctgacacccaggcggtgcgggatggttctgctgcaaggcagcgcccgtcctcccgcctgcaatttaccgaggaagaacgtgccgatcccgcacttggaaagtacatcgaccgttccgaccgtgcggcggacaggctggacgcggcaaatgcggctatccccacaaagaaagttctccgtaccgagcgtgtttttgacgagaccgccggaaaaggcaaaatgcagcttcactttgaagaagtggagaaacgccccaacggacgattgcggcacaatccgctttcccggccggtccatgagatcgtccacgctgcccatgcgaaggtgcatgaggtggaacaggaaaatgtgggtgttgaggccggacacaagggcgaggtgctgacggagcgtgggcttgcctacggaaaaggcaaagtccgtgccgccgtccaccatcaccgcacaaagccctggcgtgacgcggcgaaggcagagcaggcttcttttaaggcaaacgccgactacctttaccaaaaggcactgcatgatgatcctgcattggcagcttctaacccggtatcccgctttctgcagaaacaacggatcaagcggaactacgcaaaggagctgcggcaggcagagaaaaccgcaaagaacaccgcagccacggcgaaaagtgcggcgcagaaaacaaaggacgccttcaaggaaacattcctctacatcaagcaccatagccggacggtgctgctggtgatcggcattggcgcctgtgttgctctgctgtttggcggagtttcttcctgttccatgatggcgggctctggcgtgggtggtgtatttacttcctcttatctctctgaggatgcggatatgctggctgcggaggcggcctactgcgaattggagcaggagcttcaatatgagctggaccactatgaggctctgcaccacggatatgacgaataccgttttgacctggacgagatcgaacatgacccttatgtgctgatttccattctcacggcattccatgaaggggtgttcaccatcgacgaggttcaggcggaattgcaaatgctctttgaaaagcagtacatcctgacgcagaccgtggaagtggaggtgcgctatcggacggagacacggacagacagcgagggaaatgactatgacgtggaagtaccgtacaactactatatctgcaaggtgaagctggaaaacttcgatctttcccatgtgccggtctacatcatggacgaagaaacgctttccctgtatgcggtctatatggcaacgctgggaaaccgggaagatttgttccccggctccggctatgtagacaagtacaccaaaccacccaccacctatgatatcccgccttccgcaatggaagatgaaacctttgcagcgctcattaccgaggcggagaagtacatcggctatccctatgtctggggcggcagcaatccgaacacttcttttgattgctccggcttcgtgtcctgggcgctgacgcaaagcggcgtctgcaatacgggcaggctgggagcccaggggctctacaatatttccaccccggtatcctctgccaacgcaagacccggcgacttgatctttttcgtcggcacttacgatacgctgggcgtttcccatgtgggcatctatgtgggcggtggaaaaatgctgcattgcggcgaccccatccagtatgcagatatcaacacaagctactggcaatcccacttttacgctttcgggcgaccgccctacaactaaaaaacgatatggaggtaatttgatttatggcaacgacacagaaaatccgcaatgacattgcgaaaaccaaagaaaagatcacggagcagcagaaacgccttcgtgcactggaggcccaacttgcggaggaagaaaatctggaaatcgtccgcatggtgaaagccgtgaagatggacaacaaggagctgaccgctttcctgaaagcctatgccagcggcatgatctccctgccggaaggtatgctgcaggagggcaacaccgagaatgaggaaacggagggatacgaggatgaagcataactttatgacaaaaatggtatcggctcttttggcggtggtgctcagcactgccgctttttctgtcaccgcctttgccagcggcggcgaggaaaccacggagtccgtggctgaacaggaaacggccggtgatgtttctgatctgctttccgctctggcaggcagccaggtcacggtatccgtcaccgaggacggtatccagttcagttccggcgaaaatgactccgggcagaccggcaccgtcaccacgggcggcggcaatctaaatgtccgcactggcgccggaatggattataccgccttcacccagcttcctaacggaacgaccgtgaaggtgatcggcacggacggcgactggctgaaggtcatcctgccggaaaaggtcggctatgtctattccggctacatgacggtaagtgacggcgaggctggtcccggagaaggttctttctctctggatgcggaaacactggaaaatctgctggggatgctgggcggtggtttgaatgacggtgccgccctgacgccggacgggaacctttcgctgattgacgatatcggcagtccgaccgccagcggcaagcagtttattacagtggaaacgaagaacggcaatgtgttctatctcattatcgaccgtgacgacgagggcgaggaaaccgtgcattttctgaatcaggtggatgaagccgacctcatggcactcacggaggatggagaaaaggcggaaacacctattgtctgcacctgtacggaaaagtgccaggccggagcggtcaacactgcttgcccggtctgcgtaaaaaaccttagtgaatgtgttggcacagaacagaaagctgcggagcccaccgaaccgcagaatccggaacccgaaaagaaaagcaataccggggcgatcctggcggtgctgctgatccttgcagccggaggcggtacggcggtctatttcctggtgctgaaaccgaagcagggaaagaaagttcccgctgatctggatgatttcgacctggaagatgaagaagaatatctgaccgaggacaaggaaacggaggaaaataatgagtaaactgattatcgcagaaaaaccgagtgtggcaaaatctatcgcatcggccctgggtgcttcatccagggccgacggcttttatgagggcaatggccttcttgtatcttggtgcgtggggcacttggtatccccgatggatgcgggcggctatgacgagcgtttcaagaaatggcgttatgacgatcttcccattctgccggagccgttccgctatgtgctggcaccgggcaaggaggatgcttttgaaaatctccgtgccctgatgaaccgccccgatgtggataccattgtcaatgcctgtgacgccgggcgtgaaggtgagctgatcttccgactggtgtatgaaatgaccggatgccgcaagccggtccttcgcctctggatttcctcgatggaggacagcgctatccgagagggcttttctgacctgcgccccggcgccgattatgaagccctgtatcaatctgccctctgccgccagaaagcggattggctggtggggatcaacgccacgcgccttttctccgttctctatcaccgcaccctgaatgtgggccgtgttcagacccccacactggcaatgctggcggagcgtgacgcgaagatcacgctgttccacaaagaaaaatatcatctgctgcgcctgacgctggatggagccgaagcagtgtcggagaaattcactgatccggcgaaggcggaacaggcagcggctatgtgcaagggtgctgccgtcacctgtacctctgtcacgaaagagcagaaaaaagaacagcctccgaagctctatgaccttaccaccttgcagcgtgaggcaaaccgcctgttcggatacacggcgaaacagacccttgactacgcccagagcctctacgaaaagaagctgctgacctatccccgcacggacagccggtatctgacctccgacatggcagaaacggcttcctgcgtgatccacctggcggcgaaactgccaccttttgatggctgcacaaacttcttcccgctggtggagaccatgatctccgacaaagatgtatccgaccaccacgccattatccccacgatggagattgaaaaggcagatatcaagggtctacctttgggcgagcgcaatttgttcctgttggtctgctgcaagctgctgtgtgcgtcggcggagccgtatatgtatgaggcggtcacggccacctttgattgcggcggctattccttcaccgcaaagggcaagcgcatcctctccgaaggctggcgggagatcgaccgcattttccgtgcctttctgaaagaaaagcctgcggatggggacggcgatgcgctcccggacttcaccaaagggcagacttttggcggtgcggaggttgctgttaccgagcattttacccagccgccgaagccctactccgaagataccctcctgtccgctatggagaacgcaggcaaggatgatattcccgatgaggcggagcgaaaaggtcttggcacgcctgcgactagggcggctatcatcgaaaagctggtagcagccggatttgtggagcgcaagggcaagagcctgatccccacaaaagccggtatcaaccttgtcacagtcttgccggagccgctgacctctcccatgctgacggcggaatgggaacaaaaattgacggagatcgcaaagggcggcgctgacccggatacattcatggacggtatccgcacgatggttcaagagatcgtgtccacctattcctgcatttccgaggatggcaaaaagctgtttgccccggagaaggaagtgatcggtacctgccctcgctgcggccagccggtttatgagggcaagaagaactttgcgtgttcggatcggtcctgcggtttcgttctttggaaaaatgaccgcttctggacgagccgtaagaaggagctgacaaagaagatggcggcggagctgttgaaaaagggccgcacttctgtccgtggaatgtggtctgaaaagaagcagtccacctatgacgctacggtgattctggatgacacgagcggcaagtacatcaatttcaagctggaatttccaaaaagaaaggttggtgctgatggcagaaaataaggctttggaacatttacccgaagtgagggcggcggtggctgccctctccccggaggatcgggaactgttggcggcggtgcaggcctcgcccttcaagctgacaacaccagatcaatttaatgagtttgcggacaacatcgactatttcgtatttgagcccaatatccacgatctaaatgatctgggctggcggtatctggcacagcacatggatatgctgctgccaccggaacttctgaaggcaatcgaccctgttccttttggcaagtatgccatgcaggaggaacaggggcattttacggaacacggatatatttctctctccggcgacgagtggaaccatgaacgccctgcggagccggagaaaaagccctccatccgggaacggctggaacagggcaagaaggaatgtgcggagaaatgcaaggcgcagccccataaggaaaaatctgcgccggaactgtaaggaggtgctgatatgccatattacgatcacgacaaggattatccctttgccgcctttatcaccaatcttgggaagtacaatgagggcgagcttgtgggcgagtgggtgaagtttcccaccaccgccgagaaattgaaggaagtgtttaagcggatcgggatcggccagaaggatgacttcggccagccctatgaggaatggttcatcacggactatgactgctatgtggacggtctttacagtaagctgggtgaatatgaaaatctggacgagctgaattatctggcgtcgaagctggatgaaatggaccagagcgactatgcgaagtttcaggccgctatggagatcggtgactataccagcagcctgcaggaaatcatcaacctcaccgagaatctggattgttatgagatttaccccaatatcgaggattatgacgatctggggcgttattatctcgaagaactggaggtttcaaaagttcccgcccacctgcagaactatatcgactatgaagcctatggccgggatgtggcgttggaagaaaacggcacttttaccgatcagggttatgtgtgggataccagagaagccttcaatgagtattatgacggcgagcgcggcagtatcccggaggaataccgggtgatgactttccaggatgatctttccgaagaagaaaaatccgagtgggctatggatatcgcctttgacatggacgagtttttccgtcagaacgatccgcagtatgcggcggagcacccagaggcgcacgccgcaaaggaagaactttacgaaagcctgatggcagggcgcatttccgctttggatgaaaagctggcgacgctgggacagacgcaggaggattatcttccttcggaaattgaaaagttcaaggacgccacaggctatgaggaatttctggactttgaccccgccgagatcaaggcagcattggagaatccggacaagtcccgtattgacgaaatgttggcctttgcggaaaaggcagaacgggagtacatggcggaggcggccgcctatgtgcagacacccgccgatatcacggagcaggcacaggccgttccgagagataccttttccatctaccaactgaaaccgggggacgcaacgcgggattaccgctttgagccactggacgccatccgcaacaacggccattccgtaaagccggagaattatgaactggtctatacctccccgctgacagaaaaggatagtttggaaagcatttatacccgctttaacatcgaccacccggcagacttcaagggacactccctgtctgtgtccgatattgtggtgctgcatcaggacgggaaggacaccgcccactattgcgaccgcttcggcttttctcaggtgccggaatttttgcagccggaacgggcagcggaggtcacgatccctacgccggatcagatggcaacgcaggagcggatcagcacgccgagaggcagctttcaggtgacggctatgagccgggagcagatggaggcagccggttacggtgtccaccatatttccgatgatagaaagtaccttatcatgggaaacggcacacgggcctttgccgtggcagcggagcagccggaaaaggacaatcctctccgcaccgctgaaatgacgctggaggatgactacggcatgatcgacggcgttatcaacaacggcagacgcggcgaagaattggaaaaagcccaggagtacgcagatcggacaacgccggagaagccttccatccgtgagcggttggaggatgccaaacgggagtgtgccgagcacaagccaccggagggcaagaagcccggtcgtgatgtgccggagcaggactgcctatgagccgaagcaagaagtggcggctggaatgggcgttcttcctgggcgagaacggcaggcggcagtataaccatatctgtaaaaaatgtgttcatggctgcaagcagagtttccgggcgtgtctggtcgcttgtccgtattacaattccaaacgatctaaaatctgtgaaaataagggtggaaaaaccgcagaataatttcctgtatccgtattttcaaagggagcctttatgatttctcatgtgtcggtctgcttgctggcacatgaagaaaaaggcttgatttcagacactttcaggcacacaaaatgggagtacagcttttcggttcgtccgatcggctgtactcccgctttttctttttaatcaaattatttgaacaggggtacaaactgtacctcagttagagaaggatttccatagtattttttaggattggataggaaaggatggatagccgccgtagtaggcgctgtgggaatgtgcgtaaactgccaggaatgcgcggctgtgggaaagctgtttgcagacccgtgggaaaaggcttgtctttttccatcaggttgtgaatggcttttccatcggcacgagcggcagttttccatatttccatgacgcaggaaatcatccaacaatcagccggtacaccgtcagcggcacataccacactgccacgatcagccgccacgccagaacaaagccgccgatcacgccaccgataataaaattcagtgcgaacagggcgatccctccacccagggagccgccgcccggcacgatccagaggcacatccgatggagtccaaacggcagcccgcagagtatccagagccatacatagtcaagctctccgttcttcacgcaggcggatttgaagatacaatacaggatcagtgccatggtcacgggcaatacgcttttgaagaaaaatgctttgattgcttcgcttcttgtcatcggtaaaacctccttccgcagttccattatacaggatgccaagagctacgcccagcgtctttcagagaaaattattcaagttcatgccgccgctgttgttcctgttcctttggaacggttagtagcgcatccacattttgcttgacggtatcgtattcctgggcttcggtccttgcggttttgtactctgcaaggagccgttccttttctgcgttgagattggcaagctccgttttcatgctttccgttgtcggcagcggcacagcccccagccgtttcaattctctggcggccgcttcaaaaaggatgatctcgctctcatgcccccgcaggaacttttctttatcatttgatttacggtatcggtcataaagcggctttagctgacggtaagttccggcatgcttcatcacaagggcaagttcggcacttctgctttctatccgcttgatctctgcatgagcggtatccctgtgtgcggatattgcggtcaatttgctttccagttctccataactgcttatcccgtgttcggccaggaaattcatggtcttggcggcctgtttcagattgttcagcttcgcccaatgggtgaagcctgcactctgctgcgccttgatgttgttctgaatatcaatgagcaggctgatctttccgtcctgctgtttcggctggcgggaaggtctggcgtgtccggcgatccgggcagcaagggcttcttcggtgtagtccgcacccagggttttcagacgggtgaatcgttcctgatccggcgctctggcggagatatacttgccgcacttgatctcataaccttccctctgcaggcagcgaagcagttcttccaggttggaacaggctggcaggagccggtcgatggccgctttcagctttgccttatagctggtgccgttctgcgcagcctgatgttcaatatagctcttgcccttgtcctgtccggggatgatgacagacagaccgtgttccttgcaaagccggtcggaggtgcggcggatatagtgataactctgcttgttggaatgatagtgcttgtggtccgcaaagctgaccgcattgaaaatcaggtggtggagtagggaagcaccgccttgtcacattgctgtgataggtttgcgccaccctctccgggaaccgtacgtacccctctcggagtatacggctctgttgctgctcattcagacaaaactcactttttgtggataatactgcggtggcaatccctgcacaccacaagcgtttttctgtgtttggcaatcattgcgatttcccaccgttccttgcctttgagatttttgagtttgttaatgtggtgaacctcgtaatggtcgctctctgtcgttccgcataactcacagacctttgctttcagccggttttcaagggtattgactgcgtatccgtagacaacggcagcattgctgatgtaatccgtagcagggcccttgcctttgcagtcggcgtaatttgcgaagtaacgccttttgtttccctgcttcgtttcatagggtataccccattttcctgtgccatcattaaacttgtcaatggttttggataggctggttttatgctttgaagcaagggtttttaagcaactgtattccataaggtaggcaagatagtgcagcttgcaaaagttgcttgccataccataatagttgcatattcctcttaactccgcattgtatactgaaacgatttctaagtctgtgagcccaaccagatatttccgatgaactggaaacatggaaccatctttcttctgtatcgccacacctttagtgaaaacgaattgacggattttatcgttaagtggcaccaacagttctacacccccattgagggtacgcatttttacatgaccggggccaccccgctttatttttccgcttctgcgcacacgcacatcatagcctaagaaccttgcacatttactgctatgggttatgagcgttttatcttcactgagttccattttcagtgtatctccgataaactcggccagtttgctcttaatccattgacagtcctcacggtttcccttgactgctattagaaaatcatccgcataccgaacatatttcagttttttgtcggtctgcgcagtgcagggaatggtcatcagtttctgacgtttgggcttatactctgccagcaccatttccctttcctcacctgttactttcgtcaagcggtgggatagccgtttgatttcattgtgcagctctcggtattcaggtgtgatttgtcccactccgggcgtgtcaaattcggatttcaacttcattacaaacttgtccaattcatgcaggtagatgttggcgagtagcggagaaatgataccgccttgcggtgtaccgctgtacgtcttatggtactgccaattctctaaatatcctgctttcaggaatttgtaaatcagcttggttatccgagcgtccttgattttattgttcagcaagcctacaagaacagcgtggttgatgttgtcaaagcaacctttgatgtcgccttcaacaaaccaacgcgtaccgttgaactcccgtctcaactgttttaaggccgtatgacaacttctttttggcctaaaaccgtgggagacatccagaaagataggttcatataccgcttccagtatcatccgcaacacttcctgcaccaatttgtcagtaaaggttggtatacctaagggacgcagctttttgcggttattcttcttctggatataggttcgcctcaccggcatgggctgataggtttcgtctgccaatgctttgataatactatctattttggcttcactgaaaccgtccgccgtatcctcgtttactccttttgttgccgcaccgttgttggcatacaggtttttgtatgccacaaagtaaatgtcaggacgcaacagatagcgatacagttttgtaaatacttcttctttatttgcaagtgagttttgactgattcttgctaaaatttccgttgttggcttcatgtgaggttttcctccctaatcaacttctaattttagtgcgcaataactgtgccccttcgccatgtaagggtcattacccctctcggactactacgagcactccgtacccatgcaggattttcaggctccaaagccatagccgctttttcattcctcctttcgtgcggcactcctggttagggcatccccggttagcaatgagacttggtaaattcggattctcggtatcgctttcgcttcgttaccataggttcccctacaggttgtacggaatgattgataaccgacaagcccacaaccataacttgccttttccgtaccagaggtttcaggcaattttcctctatcggcacataacagaaactggaagctcacgttcagtaaatccaacttataccttatatccgattaacattgcggttcagtcgcacccgattgcctttaggtgacttaccgctttccagccgtactgtgttcccgtgtcagctttcgcctttcggttaggctggttgtttcccgcgttatcttacggggcagtacctcatactgcttttctcattgccctatccgggcgtacgttatgaacatgatctttgtctatatgggtagtaagtacaaattcatacttgctgcccaggatttcttttgcaagctccatgccgatctcatgggcctgttccggcgtaacctccccaggctgaaaggcttggatcaggtgacgacccaggttcgttcccttgtcgatggcatggcggcgggtccaggaaaattcgatatccgcagtttcggcggcacagccataggaagaaacaagcagctttccgtccgtcttttccgggttacagatatagtcaatggcggctttcagcgttgacttgataggatgtgtctttgtaactgccatatctcatccagcctttcccgtatctcgtccatgtcggcctgatacgcaggacctccggcgttgatccgcttggcaatctggttgatattccgaccaatggcggaaagctctttggtaaatgccctgatatctgcggtgtccgtatagatgatatatccgtcaatcgccatcttgcggaggtaagcgccatatctgcgtgtgggtaactggctcattttttcgtctatgagccgtttttcgtcctccgtgacatagaattttatttgaatatttcgctttcggtttgccatgcgccacctccgttcctcataagggtttgggactatcccaacaagcaattttgaattttcgggtaagggacctgaaaatctcaaaattcgcaagcgggtactcgcttgctgtgcttgctaccgtatcttatccctacttataaagcgttgcggaagtccaaaaatgcccgcaaaataagaaaaacagaggatgttcagacaccctccgtttcttcattcggcttttcaatttttaaggccccgtcaatggcaccctccacgataggcaaatactgttccgggcagagctttaacttctgtccgacccgctggcgcagctcgctttcctctcgcatgacctctgggttgaaatatctctccatcggcagaccgcagatttttacaagctgaatgatgaccggcaggctggggatcgtgccctcattttcgatgttggcaagatacctggtatcaatgttcaccttttcggctaaatcttttcgtgcaaggttcttcgccttccgtgcttcttttacatccgcaccgaaggtttcaaagccagggcagtctttaacttttgccattcaacatcacccatatacattctatatttcatagtttgcgcatggaatgatgctatatgcttcttatctacattttataattcagtgcaaaatcagacgagcgccagagtaaactctggcgctcattttactttcgttgtgcgttttttctgtactctaatggtaacaatccagtgcttttgcggaataattctgcaaatcggcttgaagtggaataacctactgtttgggcaacttgccctactgtcaactctgtgtatgccagcagatattctgcttggctcatacgcctctgctgaacatactctgtgatggtgcagtcgtagtatttcttaaaacagcttttgagctttgttgttcccatgcaggcaatctgtgttagccgttccaggggaatatcaaaagcatagtggtcgctaagataagcggcaactatttgaagattttcaatatcctgttgagagagcttatgggctggtttatcaggatgtttcttctgatattcaaccaccattgaaacagcttctgcaactttaccctcataaaaaagttttgcggcaatcccttccccgcgatagtctttgatttctgtgagtaaccgtgacatttctggaaagtcggaagtttggtcgatcttccgaaatgcatccacaggattgatctgcgcctctgggtacagttttttcaggtagtcttcataatatgccggtgcaatctcaattccaaccgaacggattggaatatttttatgtatcaaagccttgtatggagcgtagccgccaataaatgttttgatacaaccagcagacagcctacggtatggagataattcctccccggaaatagagtcataccgagtgatactcagacattccggcagggagcattccaacatgaaatcttcgtggaaggaaaagttgtggattttaatatcatataggtctttctgtccataagtccagtaggtgccttctccaacttcgggagaaagtttccagcagtcacctaatgccccatattgctgattgtctgggtcacggataaaaccgtgttcaatcagcagaggcgtataaaattggtcgataatttcagacataaaacagaccgcctcctttttgcaacgattggacgaacttttgaaaggaacagacgaacatcgtcggaacccattgaatgttgttcgataaatgcgtattgtattagaggatggttagagctatctaaccaaagaatatcacaaaccacttgttgagtcaagacaacgaaaggtaggaggtcaaaatgagtaatcaagtaaattctataaacaggggtctgacagtgaaagaccttgtaacgacaggtatttttactgcactgttatttgtttttgtattggtgggcggcgtcttttttgcaacgaatcctgtacttacttttttcatgccggcaggaggtgggctgcttgctggccccatttatcttttgctgattgcaaaagtacataagcgttggagcctttctataatgggcattatcatgggtattatttggttcgtgaccggtatgcactgggcttttgcattgggctacctgatcatggcgattgtcgcggacttcgttgctggtgcagggcagtacaaaagcaaaaaactcaacagcctgtcttatatcctgttctctctcggcggcactggttcgtatatcgtgttctttgttgaccccaacggctgggcacagactatgctgggaaacggaactgaacagagctacatcgacaccatgcaggcaactgcaaataccggcatcctgattgccatgttcgctgctgttatcattacatctgcaatcagcgcttttgtaggctgcaaaatgctgaaaaagcagtttgaaaaagcaggtattacagcatgagcggtaaacgccacaagaaagggctttggctcgacccacgggccaagctctttcttattcttatatgtgttttatcgtccatgttcgctccttcacttgcatatcaatttgtccttgttatgctgattgcgatattgggtgctttctttggaaagtggaaatatgtcattaaggctgtatgcttttatgcggtcatctgtgtcctgacagtttggatcatggcagaaatgacaggcacgctgcggacaatgtttattgcctttttaggattgtttcataaggtctatgcgtgcggaaccttggctgggattgttctgactactacaaaagtcaatgagttcctgtctgctatgaaccgtgtccacgcacccaaaaagttagtaattcctatggcagttatgctgcggtacattccaactattcaagaggactggcgatatatcaaggacgctatgcggatgagagatgtttcaccttctctggcgggctttttagcacatccgggcatgacggttgagtgtatttatgtgcctttgttgatggcagcttcaaaagcagcggatgatctttctgttgcttctgtcactcgtggaattgaaaatcccaatccacgcacctgtcttgtccagataaaatgcggagttgccgattggggtgtcatggccgttgccgtagcttatctgatttttgaattatgtgtgcggggaggtgtgattggttgattgagtttgaaaatgtatcgttttcctatacggggcaggaacatggtgggctgcatgacatcaatttgaaaatttcggacggagaatgcgtcctgttctgtggccgcagcgggtgcggaaaaacaacgattacaaggctggtgaatggactgatccctcagttttatcagggagagcttcatggccgtgtgttggtagatggtcaggaaatcagcaatatccctatgtatcagattgccgctaaggttggctccgttttccaaaatccacggacacagtttttcaatgttgatacagacagcgagattgcctttggaattgaaaatgaagctcgccctcctaagaaattggctgagcgagtagagcagacaactgaagatttgcgtattcaaaagctacggaacaggaatatttttgagttgtccggcggagaaaagcagaaaatcgcctttgcttctgtttatgccatgaacccacagatttatctactggatgaaccatcatctaatctggatatgacttcgatccaggaactaaaggaacatttgcggctgataaaaaaacagggcaaaacaattttgatagcggaacatcgtctgtactacctgacggagttggctgaccgaattgtttatctggaaaaaggagaaatcaaaggaatatacaccccgaaagaatttcggcagctatctgaacctgaccgtgaacacatggggctgcgggctgttgatctacaggcggtattcccaccaaaagcccacttgcctgcgcctacccctgtattggagctgcggaatgtgacgctccgttacaagaagcaaaccattttgcatgacattggactatccgccggaaagggcgaagtgattggcgtagttggacataacggagctggaaaaactacattttcccgcgctctctgcgggcttcacaaagactgtgatggacaattcttgtgggaaagaaagccgattgagcgtaaggcaaggctaaaacgctcctacatggttatgcaggatgtgaattatgaacttttcgctgacagcgtggaggcagagtgttcctttggtatacgcaatccagatcaaacactggtaaatgcaactttggaggaattgggccttaccccataccgggagcgccatccaaacacgctttccggcggtcaaaagcaacgagtagcggtagctgtcagcatgatttgtgggaaagacttgcttgtatttgatgaaccgaccagcggtcttgactttgacagtatgacgcaggtggcgggactgatccggcgattatccgatatgggaaaagtcattttcattgtcacccatgattttgagtttgtctgccgtacctgttctcgtgtcttgcattttgacgaaggcgaaatgcccgatgacgtatcagttgtaatggaggccctcccgaaattgagagagcttttctctgtttcagatggaaaggagaggtagtctatgaagcagaaaaaagaaaacagtatggcattgctgctccattgggccggagaacagaaattttggttgtttctggcaatcctgctgtccatgtgcagcgggctgtgtattattgtcccatacattgggatttacaggttgatggatgccacattcaacaatgcctgcacaaaagaacttgtggtgcagactgtggcaatgattgccgctgctgtcaccctgcgttttgtactgttcggatgttccggcgtggctgcccataaaggcgcgtatggtgcactgttcaaagtgcgctgtatggtggcggaacacatggccagagcgcctttgggtgccctaaatgaacggcgcacaggggatattaaaacggttctgaatgaagacattgaaaaactggaactatttctggcgcataatcttcctgaccttgtgtgctatctggttgggccggtggtcatctttatttatttgatgaccgttaatgttccactggcgttgatttctcttgttccgctggttctggctgtagttgtaatgggggcgatgttccgcaataccgatgatttgatggaacgggccaaccaatccattaccacactaaattctgttatgatcgaatatatcggcggaatgaaattgattaaagcctataacatggggagcaagtccttccagaaattttccggcgcaatccatgaggaaaatgccatgtggaatgagacttcccgacgtatggggcctccgtatgcagcgtttgtcgttatcattgaatgtggaatgctgctgatggttccgataggcgggatgtttttcctgaaaggttcactgacagccagtgcgcttctgctgtttgtttatgtcggttctatgtatctgacggaaattcggcctttacaggaattgggtacaaactttgcaaatgtactgaacgctattaccaagaccaaagagatactgaatattccgatttatgagggtggaacagacttcccccaaaaacatgatattgaacttcagaatgtccgattttcttatgacggcaaaaccgatgtactgcatggtgtcaacctcaaaatcaatgatggtgagcgcatggctcttgtgggccgatctggtgctggtaaaagcactgtgattgaactgatttcccggttctacgatgtgcaggaaggagaagtgctgattggcggcaaaaatgtcaaggagcttgactacgataccattctgaaaaatatagctatcgtatttcaaaagaccttcctcacccgtgacagcgtgctggaaaatatccgtatgggtagtaacgctactctggaagaagtgcgggctgccgcaaaagaggcacagattgatgactttatcatgtccctgccggatggatatgacacaaaagtgggcagtttcggctcccgcttttctggcggagaaaaacagcggatcgcgattgcccgcgcaattctgaaaaatgcacctatcttgattttggacgaggccacaagtgcctctgacccggaaaatcagatggagattgataaagctattcaaaatctatgcaaaggcaaaacagtcattgtagtagcacaccgtttgagtgctttgaaaatgtgcaaccgggtggctgtggtggaaaaccatacaattaccaacgttggcacccatgaggaagttcggaagaacaacgcctactatcgaaaagcgtgggatgactacgaaacagcccggaatatcacttatcagttggagggaggcgagcagtatgaatgagcacgatgtattgaaaaaaaaccgcaatttctatattggtgtcggcggaaccgttctggaaggacttctctccggcagcctgtttatgctgctttactctgttatgcagtttttgtggtcgggtcaatttgacatgaaccgcgttctggctctgaccggtattattgcagtggtttttcttctccgtatcctgatttacagctacggttataccaaagcgcagattggcggtgcggaggtcagtaagaatattcggctttttatgggtgaccatttgaagcgcatcccactgtcccgctttacgcaggggcagaccggcgattatatcaacaccattacaagcgacgtaaacaactacgaaaaaatcctgacccataaagtcggagatttcgcaaagaattttgccctgtcattgatgttgattgtctttgttatgacgctctatgttccggcaggaattatcctgctgatagccgatcttcttttaatccccggcctatggctttctttccgcatggtacggaaatatggaaaagaaaagaacgatatttgtgcggagaacgtcagcagcattgttgagtatgtttctggtattcagactttccgagcttatggtgtaggcggtatgaagaacaaaactgttatcaacgccatgcgggagttttcccggatcagctttgtgtacgaatcaaaagtgcttcctattggtgcggtctttggtattttgagttggctgtcctgcccgctggttatcttgctggcctatgcaccctgggtcgcagggacactgaacacggtggactaccttttgatttgtatgctgcccctgttctgtgcaaagctggctaactcgatttttgtagaccttaccagttataagaacctgatgatctcgaaaaacaaaatcttgagtgtaatgaatgagccggaggaaactggcagcatggagccgcttcacacagctacccatgaaatcacatttgacaatgtagattttgcatatgttcccggtgaaccggtactaaaacacgccacctttacggtgccagatcaaaagctcacggccattgtcggagactctggctccggcaaatctactattttgaacctgattgcaaaatattatgaagcaacgggcgggacgatttctattggcggtaaacccattaaccatgttgccgcagagcgtgtactggagcaagtttctatggtagaccaggacatatttctttttgacgataccatccgggataatatccgacacgctcgtcctaatgctacggacacggaaatcgaggctgcctgccgggaggctaactgtgacagcttcatccgtaagatggaaaagggatacgatacgccgactggcgagaatggaaatcttctctctggcggtgagcgtcagcgaatttcaatagcccgcgccatcctgaaaaatagccccatcctgcttttggatgaagcaacagcatctcttgacattgaaaatgagcttgccgtaaagcaggccatcgccaatctgctaaaagaaaaaaagacagtggtaatgattgctcataccctttccattgtcaaaaacgctgatcaaatccttgtaatgggtgatggcagaattgctgaatctggaacccatgaggaattgcttgcgaaaggcggaaaatatgctgctatgtggaacgcagagcaaaaaatatcggcttgatagaagctaaagaagaataattgcatagcgcatgaacctgccccgactacggggaaagaaaaaaaccgctggctggggcaggtgattttgcgcgcctattttaagttattatcctaacggcggttttgagaaatcagagccgccgtttctttgcgtttacacaaaccaatgacgacttgcagggacacggtagtcgatgggaggttattttaccgtgtccttttctctttttcgtagtatccatgatttgcaccagctaaaaaaagcgtagtccctccatcggagccatccggctttgaatgtgaactataccatgtaagcaatcatccttataaaacacttccgcgccctgcaggtccgttgcgacttgctgggcgctttttgctgttttctgaggacaagcccgcctcgaaaaaaatttttaagaaattttcaaaaaggaggcttttagcgggtagcgagcggctttgcgttcgccttgttagcggaaagggagaaacccacctcattcccccaggaaagggggtgaaaagatggatatgatcccccgcaatgactatggcgagcggtgccagttcgatgcttactgcaagctggtactgtaccatgaggcaatcgactacctccgggaaatgcagaggcgccgtgacagggaactgtcattcagcgaccttccgcaaatggagatggacaagctctgcgttgtagatcattaccccagtgacagatttacattctcgtcccacggatatgacctgcatatcgaaaacgagctcgtggctgacgccttcgccggcttgtctgttcaggagcagagtattttgatcctgcattttgttctggacttgccggatcaggaagttggtcgccttgtgggaatgtctcgcagcgccgtacagcggcgaagggcaaaatcactcaatgagctacggatcaaactggctgcgctcatgccgaagggaggttgaagaaacgatgaagcctacatacaagggcaaggagcttcttcctctttcggtgatcgacgccgcccgtgacgggggctctcaggctgtggatcaggtactccggtattatgagggctatatcaataagctctgcacgcggacgctttacgatcctgacggtcagccccatgttcgggtggacgagtacatgaagcgccgattggagatcaagctcattcattccattgtcagcatgagctgacaagcccggtctgaaagcggaaacagcttaccctttccctgtttctctctttcgtggtcgaaggcagcaccttgacaaagaaagcccgttgggaggccaacgccgcagtataaggcaaacggatacattcctgtttgtgccgagccatacggccggtgcgccatgacctcgtttcaagtccgcaggacgggaccactgtaacgggcgagcgaacagcaccagaccgcaaagcaagcgtggcagcttgcgggcgatgacacacgggcagggtcaaagatactcgcgcattgaacgcccacaaagcattgtgcgccgcacccatcagcatgggccggggttagactcccgtggagctgtgccagcagccgtccgtaagcctacttttcttttttgaaagtttatggatagatcgtaaacttttcaattagcagcagacaaacacggagcagcacggtaaaataatggtggaagttatattacccacacatattcgtgctgttccttttcataactgaaagggggttctcatgtctcaaacatggaacggcacgaagaaagaaacccctgaaagaaggacgtatacggttgacgatattgctcaaattctgggcatcggaagaacttctgcatatatccttgtaaaagaagggcacttcaaaatcgtgcgaattggtaacgccatacgcatttccaagcggtcatttgacgagtggcttgactccctcgacctgtgatccaagaaaggaagaacgatatggcatctataatcaagcgaaagaaaaactattccgttgtttacaactatgtggacgaaaacggagaaaccaaacagaagtgggaaacctggcatacccacaaagaggccttgaagcgcaaggcagaaatcgaaaatcagcagcacacgggaactttcctccctccaagcaatcagacgatcaccgagttcctttatgacttcgtatctctttacggagaaaagaaatggggcgtgtctatgtatgacagccaaacggcgctgattgcgaactatatcaatccgatcatcggtgatatggaggtacaggcggttactccccgtgcggttgacggttatatccagaccttgcagaaaaccaagtcggtgtctaccaagacccgaaaggctgttaccacctatgtcagcgacaagaccattgaaaagatcatcaagctcctgcggtgtgcgtttaagcaggcggtacgatgggaaatcattgcaagaaatccctttgacaatgtgatcctccctaaaacggagtatgcgaaacgggatatctggacagcggatatgatccgtcttgccctggacaaatgcacggacagcaagctctatgtggcaatgaacctttcctttgcctgctctctgcgtatgggtgaaatcctggggctgacctgggagaacgtccatatttccgatgaagatattgctgcggataatgcctatgtctacatcgacaaggagctgacacgggcttccaaacgggcgattgaaacgctgggtgagaaggatatctattacatcttcactccgctcatgccgaacaccagcacaagaattatcctgaaaaagccgaaaactgactccagtatccgtaaggtgtggctgccgaaaacgctggcttacatcctgcgggaatggaagaagtcccaggacgagttgaaaggcttcctgggcgacgagtatcaggacttcgatctggtggtggcacttcccaatggacggccctgcgaggatcgtatcatcctcaaagagtttgcaaagctccgtgaggacgcagggctgccgaaggtggtctttcattctctccgtcattccagtaccacctacaaattaaaactcaaccacggcgatctgaaagccacccagggcgatacaggccatgccgagatcgacatgataaccagtatctatgctcacattctggacgaggatagaaaggtcaatgctcagaaatttgagacagccttctatgccaagcctgatcttcgcagcgtccgtccgccggagaaaccggcaaaatcggagcctgcgacccttgaccttgaaagtcttgtggagcagcttcaaaagtcgccggagctggcaagtgcgctcgcagccctgatagcggcgcaagccccggcaaagtgatccgaaaaatcgaattagcaaaacgcagaattttcttagcaaatttctgaaaagcgttcgagtccaattagcaaatatacatcatgcggcgtataaaaatctcccggtaacggaagcaaaattactgggagaaggaggaacaaaaaaacgctgcaaaccccgaaaaaaggcttgcagcggtgctttctggcgtcccagagaggatttgaacctccgaccccacgcttaggaggcgtgtgctctatccaactgagctactgagacatttttaagatttatgcaattttcattgctcgaaggaatcgaacgatctgccgcttaggaggcggacgctctatcctgctgagctacagaaacattcagatatatttataaataactgaatggtaaaacacaattaataatataacatgaatcagtaaaatactcaactttttttctaaacatttttacattttttctgtctggctgagagataaaataggacatgatcctagaaattaatatatccctgcagccagattgttcccttaaatcttcttccaatctcaggctcacccatgacttcttttgcgggtacgcatacatcgaactgcagttcatttacatccagtttcatctgatacagcggttcttttgtaagagtattttctcgctttctaacagcaagtatctctcccattattgagtacaaatcacattccacgccgtaaggcataaaatatgtatctactatcgtaaatatatcttcatgaatcagcctgcgggatactttggaatatgtatcgatatcatccagagtaagagtttctattgccgtctggtcgccgcttctggctgcattaagcagcactttcctgttatctgacgcttctttttcatttttcacctgatcctcactcttttttaccggaaacaggatcttcccggacagagcaagaccggaaaatgtaactgagactgccagctcggttgcaaaaccaagctggcgctccctcatatactcgattccattctgcagatggaaaataaggctgataccaactttcggatcctcacatattcccacatactcttccttctcgattcttttttctacaattacatcagcgtatgtggttacaccgctcccttcaaaatatggaaaataataatctgcatcgaaattttcaaattcatccagttcaccgcacaaggttatccccacattttgtccgtattccttctgaaattcacagtaatctgcccaattctgataagatacgatagtctggtgtgtaaaagtagtttctacctgattcaacagttcttttatatctttctttgtcttcaggttgttaaatccaattgctttcagatattgatgcataatattctccaaattatagtactatattatcttaatactattttctaatatatattcatgaatccgttaatttttcggagttatcactgcattccctcccatatatgggcggagcgcctccggtatttttacggagccgtctgcctggaggttattttccagaaatgcaatcagcattcttggcggagctgctaccgtattattcagtgtatgtgcaaagtattttgtcttatcaccctttacacgtattcccagccttctggcctgtgcatcgcccaaattagagcagcttcctacttcaaaatattttttctgccttggggaccatgcttctacatccacggatttcacttttaagtcagcaaggtctccggaacagcactccagagtacgcaccggtacatccagagaccggaataaatccaccgtattctgccatagcttatcataccattccatactgtcttccggtttgcatacaacaatcatttcctgtttttcaaattgatgtatacgatatacaccgcgctcttcgattccgtgcgcccctttttcttttctaaaacatggggagtaacttgtcagtgtctgtggtagctctgcttcctgcaactgagtgtcaatgaattttccgatcatggagtgttcgcttgttccaatcagatagaggtcttcgccctcgatcttgtacatcatggcgtccatttctgcaaagctcataacgcctgttacaacattgctgcgaatcataaaaggaggcacacagtaggtgaatcctctgtcgatcataaagtctcttgcataggaaatcacggaagaatgaagacgtgcaatatctcccatcagataataaaatccattcccagcaacacgccttgcgctgtccaggtctatgccattaaaacgctccataatttctgtatggtaaggtatttcgaagtctggaacgaatggctctccgtatctctcaacctctacattctcactatcatcttttccaattggtacggatggatcaattatgtttggaataatcatcatgatcttcctgatattttcttctacttctttttcttctgcagagagtgcttccattctgtctgcattttctgctactttctgtttaaggactgctgcttcctctttctttccctgtgccatcagcgcaccgatctcttttgagattttatttttttcggctcttaatgcctccacttcttgcttaatatcccggttttttttatccagttctaagacttcatctaccaaaggcagtttttcatcctggaatttgttcttaatattttgttttacagcttcagggttatttcttacaaatttaatatctaacatagtatcttttcctcttttcctctctatcttttatttaaatcatatgcttcctggaatatagctctttccagtgactctgattcctcctcagccagctcgatatagctctgcccttttacaacctctttaatataagtataacagccttccctgctgtgcattgcatttaatatccatccattatcattttcatccagcatagtcagtgcaaaacttagattgccccccatttcatggaacgcatcgtattttacgatgccaattttctgataatggagcttcatttttttataaatatcctgtatatccaattgatttttttttgcgatttccgcaatttcatcaagctcagaaaatcgtgtaagcatgctctcttctagattctttccatctttccctttcataaacgaagaataactggtttttagcctattgtacttcatatttacactgattaacataacaaataacagaacctgtatcaaaaacaaaagtataatcaaatacacaggatctagtccaatattacctaaaatcgtattttccatacccacttcctccttattaaattatgtatccccttttaccgccaaatttaccaatctattgccatcactgtttattatgctgacatttccccatattatgataagcggtacaatagtgtgtattttaattcattacatctcaatcatttcttatagacataatcagatcgaatatacgttcgagttcatcttctgaataatactcaatctcaatttttccttttccatttgcttttggactcacatttacctttgtaccaatgatatttttcatcttttcttccagattatcatagataaatgtgtgttcaactttttcgattttttgttcttttttaggatttttcagggccttaactaatttctcggtctcccggacacttaatttttcgtcaaatatcttgtttgcaagtatatattgctgttcttcatcgtctatagcaagcagagctctggcatgtcctgtagtaatcatgtcgtctactatcattctctgtactttttcactcagttttagaagacgcatagagtttgttaccgctgttcggctctttgatactctttctgcaacttcatcctgtttcagactgaattcttccagcagacgtttataggccatcgcctcctcaataggattcaggttttctctctgaatattctcaatcaaagatatttcaacgatttcctggtcagtataattttttataattacaggtatttcctttaagcctgcaagttttgctgcccgccatcttctctcacctgcaataatttcatagtaatccttttttttctgtacaaccaaaggctgtaaaacgccaaactgcttgatcgagtctgaaagttcaagaagagcatcttcatcaaaatcttttcgcggctgctctctgtttggttctacttgattaattttcactaacatttcgccagattcatttactactccctgcttttctggctgtgttatggtctcctgctttacaggcttttttacggacttatcacttctatcgggaatcagactgtctaaaccttttccgagtccatttctttttactgccattcttattcctctcctttattaatcacttcttctgctaacatcatataactctctgctccggcagactttggatcatataaattaataggcatcccgtagctgggtgcttctgccaaacggatattcctcggtattatagtcttataaatattctgatttaagttatctttcacattctcgactacctgtaaagaaagattagttctggcatcatacattgtaaatacaacaccttctatttccagtgatggattcagcctttcctgtaccagttcaatggtatgtaccaattggctcaacccttccagtgcataatattcacactgaataggtacaagtacggaatcggccgtagtcatggcattaatagtaagcatgctcaatgcaggtggacaatcaataatcacaaaatcataatcgtccttaaccttttcaatttcatttttaataatatattccttgttatcaacaccaattaattcaatttccgctgctgataagtctatattagatggaagaacatcaagattatcaaaaacttctctgcaaatacattcctcaattctggcgccaccgataatcaaatcatatacagtgttttcaacttcatttttatttacactaagcccactcgtcatatttccttgcggatccatatccaaggctaaaaccttttgtcccagtccagcaagtgaagatgatagattaatagccgttgtagtcttacccacaccacccttttggtttgcaattgctataattcttcccatatttgtactcctttcattgaacacttcactattatatcacttttttctccgcatatctatataatgtttcacgtgaaacatagaatttttaataaaaataaaaaaactatgttattaatgtcatcagaataataaaaactataccaattaatccccataacttataaattccaaacaaacctactacaaaggcaaatattattttactcttaaaagacattttgaacttttatcctaaggacgactttgaagaaaggatgcagaacaagcatatattcaagggctcccctttcaattcatacccctaaagtaaatctgtagtatagcagcaaaacagggtatgtcattctgcaaaattatatcttaagttataccttaaaagaggttctataacttagatgcagaataaattataaccaaggggtgtcctgtaactcatacccctatggatgaatccgcagcataacgcatagtttaaagtaataccgtaatttatgtcctatggacgaatccgcagcaaaactgcagattaaaataaaatagtagattacagcataaatgtttcacgtgaaacatctaaccagtataaatacccaaattcaaaatttacatttaattcgcgtaaactaattatctatcccaataaagtattaaacattatctaatactctcacaatttttttgtcttacaatccatctaaaaactcccccctcttcatttccaaaccaatcctattcctgaaccatcttatatccaaactaactaacctatcaccatccgcctccccgtagaattctcacaactaaatttatctacagatttgataaaccagacagaatggaacagtgcgccagctgcattgctggaaacttacatgtccatttctggaagcatagagagcgccatagaattacaaaatgaaaagtacatcggattggaaggataaaatttgctcaccgaagcagattttaaggcggcattcaccgcggaattcatcagaattgcgtggtgaatgccgccagtgccttccaatccgatgtacttttcatctagtaagtcttggcaaacggaccgatccaaaaatggacacgtaagttttcagcgatgcagctggcgcattgttccattctggcgtctcacttaacattcctaatataaatttttcaaatttagttaaataaatttacatgccccttccagtgtagtataatgataagtataaatttagaaagaggtgaaacatagtgagttggaagaaaaagctcacaacatgcgctcttcttggaggcactgctgccggaatgatgcatgttgtcaatagactagtttattacatttccacaatagataacctattataccataaagatgaaaaatattatgattggagattcggacgtatattctacactaaacagggaagcggttctccaattttattaattcatgacctgaacgttataagttcatcctatgaatggaataaaattgttgaaacactatctcagactaacacagtctacaccattgatctgctgggatgtggccgctcggacaagccaaatcttacatataccaattatttatacgtacaattgatcactgactttatcaaacacattatttgcagtaagacagatgtaatagcaactggtgaatccggaacctttgttttaatggcatgtgcaaatgacaacacagttatagacaaagtaatgctagtcaatccacaaaacctggttacactggcaaagataccaacaaaacgcacgaaattacttcgccactttataagtacaccgatcataggaacatttgcttacaatatgctcattaataaaagaaccatcgaggacagttttcggacacaatattactacgatcaaaataaaatcgaagaaagaagtatcatgacctgcttcgagtcttcgcacaaatccaatacccgctcaaagtatttatacgcaagcatgaaatcccgttttacaaatgcaaacgtaatgcactgcctcaaaggacttaccaacagcatctttatcatagtaggaaatgccaaccctgaaaacggactcacagcaaatcaatatcagaaccaattgccatctattgagattgttggaatagacaaaacaaaacacttgccgcaaatggaatctccaaaagaattcatagaccaaatccgcatcctttttgatatcgagggggatatctgaattgggtaggggaataggggctggttggatacggtattgtaggataactagcgctatatcaaaaaagactttgacatgacggacaccgcggatactcacgattatgccgatacatactcgctgcggttccgcttttcaccaggacttgtggtcctggtgaaagtcagcatgtcagagtcttttttgttaaagcgccagtaatcccacaaagaacgtcccactaccatcccaaaaacctccccgctacaaaatcggctcttttgagggcaaacctgcttttcgagggtatttttttttggtagattctattttttttatcgttacgaatgatctccctatttctgttcccggaagctggaattttactgttttttctgtctttcctcccaggatttttacagctttttgagatgcctgcagttcctcctctatattaccggatttataagatatgaatataccccctacccgtatatatggtatacagtactcactcaatgttgataaatttgccaccgctcttgatacacataaatcaaacttctccctatattccgtctgccttgcgtaatcttcagctcttccatgaagcgtatctatctctttcagtcccagttcctctataactgtgttaagaaactttactcttttgtttaaagaatctaatagaacgacatgcagttgtggataaactatttttaaaggaagacctggaaaaccagctccggttcctatatctatcactgttttaatgttttctatatcaatagcttttactatagagaggctgtcaacaaaatgtttctcattgacttcgtcatattcggtgattcccgtcaaattcatgactttgttccactcagtcagtaattcataatatctctggaactgctgtttttgtttttctttcaactcgatattcaattctaacagctgactttcaaatttattttccatacattttctcccggtaaatgactataatactttgtacaccatcgcttattttaaatttgtacctgagaataaaatatctttatcttatcattcattctcaaatacatcctatctgctttcaagatagactaaaagcacggaaatatctgcaggtgatactcctgatattctggaggcctgccctatggatgatggacgcatttctgttaatttctgttttgcttcgatccgcagactcttgacttcattgtaatccaggtcatccgggatgattttactttccagctttttgaattgttccacctgcctctgctggcggcggatatatccgtcatatttgatattaatatttacctgctctactacatcaaatggaagttcttttctctgtctgtctatgggagccaatgattcgtacgatagctccgggcggcggatcagttctgccagtgttgttcctgatgtgagcggtgtgcttccgaaagacttcagaagactctgcacatcatctgatgttcctatattagtatgttcaaccctcttgatttcctcttctatcattttttctttttccagaagtttcttataccgctcctctcctaccaggccaacttcgtaaccgatttttgtcagacgcagatctgcattgtcctgcctcagcagcagacggtattccgctcttgatgtcatcatacgataaggctcgtgactctcttttgtcacaagatcatctataagaaccccgatatagccctgtgaacggtcgatgacgattccctcttttccctgcagttttcttgccgcattgattcccgctatcagtccctgggcggccgcttcttcataacctgaacttccgttaaactgtcccccgctaaaaaggcccttcaaatttttaaactccagcgtgcttttcagctgtctcgcatcaatacaatcatattcaattgcataagcatttctgacaattttaacatgttccagtccgggcacgctgcgatacatggcatactgaacatcttccggcagggaactggacatgccgccaacatacatttcatttgtttcaattccctcgggctctataaatacctgatgcctgtttttatccgcaaattttacaaccttatcctcgatggacgggcaatatctgggccctgttccctcaatcataccggagtacaacggcgaacggtccaggtttgccctgataatttcatgtgtcttttcatttgtgtaggtaagccagcaggacgcctgttcaatctggaccttctcaggatccgtggtgaaggaaaaaggtacgactctctcatcccccttctgctcctccatcttactgaaatctacagaatttttatcaattctggcaggagttcctgttttaaatctatacatcttaatccccagacctttcagactgtctgtcagatgatttgcggcctgcagcccgtttggacccgtatacgtacttatatctccgtaaatacatcttgccttcaggtaagttcccgtacaaagtacaactgctctgcagcggtatatagcccctgagtaagtttggactccggtcactctgccttcttccgccagaatgtccgtaacttccatctggcggatatccagattcttctgactttgaagcacctggcgcatggtcctgctgtaattagccttatccgcctgagcccgcagcgaatgaacagccggcccctttgacttattaagcatcttggactggataaatgtctggtcaatcacctttcccatctcaccgccaagtgcatctacttcccttacaagatgccctttagaactgcctcctatattcggattgcacggcatcagtgcaatactgtccacactcaccgtaaatataactgtcttaaatcccagccttgccgcagccagagccgcttcgcatcccgcatgccccgctccgacaactgcgatatcatattcgtctttattttcccatacagaatttgctgaatatttcatttactaaatcttctcctatcgtttctccagttatgctgcccagtgattcatatgcatccatcagatctatagagaaaaaatcctccggcatctgattctcaatactctcaattactttatttaaactttcacaggcatcctgcagggcagccttctgccttatgttcgttatatatacctggtcattaaaggatatttctcccttcaggaacatcgtttttagtatttcttcaaattcctggattccttgctcttcctttgctgaaatgtcaatcataggaatatcttttgaataatttcctgcattttttgttttttcaaatactctctcgattgtattctgcaggatttccttcgttacaactgttttcaggtccgatttatttaataatatgatgcatttttttcctacagtcaactgaattatgtcttcgtcattcttatccagtggtcttgatgcgtcggccacatagataattaaatccgcatttttcacataatctcttgccttatccacacccattttttctatgatgtcatccgtctccctgattccggctgtgtctaccatattcaaggtcagcccgcccatctgaatctgctcttccagggcatccctggtagttccctcgatatctgttacaatggctctttcccggccggataggacgttcagaagggaggattttcccgcattaggttttcctgcaataacggtctgtattccctctttcatgatgcgaccgctgtctgaagaatcaatcagttttctgatgtccactaaaatatcatcaatgacatattttaatttctcactataaccatcaatatctatgtgctccggatcatccagagcagtttctataaaagctgtttggtatattattttttttcttatgtcttctattttatttctaacatttccttttaattgacttatagaactttgcagggcatattcatttttagaagtaattacatctatgacagcttcagcctgagacaaatccatcttgccgtttaaaaatgcgcgctttgtaaactcccctggttccgccggcctggctccattcctaatgaccgtctccaatactctttttaccacataatttccgccgtggcaattgatttctactgtatcctcaccggtaaatgtacgaggggcacgcatcagcatgactagtacttcgtctactgtctcctgtttatcttttacatatccataatgtatggtatggctttcagcttctaaaagcctgtccttccctctatatatcctgtctatgacctcaaatgcttccgggccgctgatacgtacaatcccaatgcctgaattcgtcattcccgtagaaatcgcggcgatcgtatcttttctcattttaagcctccccatgatctgtgaggaattttccggcaaatggataaccggaaagtccctcacattatcctaaaacttttaaaatataataaccccatcatataaaattaaatttttaaaaaagacgtttcacgacttcacgaaagcatccgtgaagcggaaacgtcctctttcgcttcaaattcatttatctttttaaggtaacaactacttttctgtacggctcttccccttcactatgtgttgttacataagggtcagactgaagcgccgcgtgtatgatccttctctcgtaaggattcatcggctccagagaaactggtctcttagaacgttttaccttgtaggcaatgttctttgcaagattcttcagtgtctcttctcttcttgcacggtaattctctgtatcaagcttcacacgcacataaccgtcctgatgcttattggcaacccggttagcaagatactgcagtgcatccagtgtctgtccgcgctttccaatgaggagtcccatgttatcccccttcatctctacacccagcgcgccatcggcatccacatcagagatcagctctacggtcatacccattgcatttaatgtatcacgcaggaaggcttcaacagcttttttggtttcctcttttacttctgcaagctcagcttcatgtctgattgcaggctgtgcttctgtcttagcagtatctttttttacttcatttttaacttcattcttaaattcacgcttaaactcattcttagcttcttgcttcacttcttttttataatgttcttttttcttgaactctcttgccggctctttctttacctcaggtttctcttctctttcctctgcctttggttcttccactacaggctccggctttcttcttgcctcgattacagcctgtttcatacctattccaagaaatccggcgcttcctttttcaatcacctcatattcaagcctgtcgctggtaacacctaactggatcaatgcttctgtaatcgcatcatctaatgtttttgctgatactctgatactaccgttcatgctgtatccctacctttctacaccgactctcctacttaccttcatcctttttatctgttgtgctgtgaccgctgttatacttgcttaccatattggccttagaagcaagactgcccggcttcgcactctttgtatactgtgctgcatttttcaggcgttcttcgcgctcagcttcagatatctttgattttttcttatcttctacatttctggtgctcgttgttgccattctgttgatttcttttgcggatgttccctttttctcacgtttcttggcagcctttttctgattctccgcaatcaattcatccgttgactttttgccaagatatttgttgattgccagctgctgtacgcatcttacaactgcactgattgcccagtaaagaccaagacctgcgggaagtgtgaatcccatgaatacggaaaacagcggcattgtatatgtcattgtcttcatggagttggccatcgtattgcctggttcaacctgtggctgcggctgcagttttacactgataaactgtgtaagaccggccatgatcgggataataactgctaatattatacctaaaattgaaaaatctttgattgcagccattaacattgtaaaaggcgcttcgccgatgttaataccgataaaactgttcagatgtcctactgtctgtgtggtggattccacaatatccttcagagaaggaatcttgtccactagagtattccatgtgctgtcctggaatttatacagcgcattcacaagtgtatctgcctgtgaataatcgtaagattttgcgctcataagtacaggttttgcttccccgatcttttccatgatcttctggaaaccgtccgttgccatgatctggtttacaaccggcatataaacatcttttacacccttaacataattcggtatattctgaataaccggatacagagcaaagagaaccggcatctggatcagcattggaagacatccgcctgtaggtgaagtaccgtacttctcatatatagtctgcatctcttcctgctgtttgagcatggaagcctggtcttttttgtttgcatactttttctgaatcttctgaatttcaggattcataaccgaagacattttagaccatttctgctgtttgatcgtaagcggaatcatcaatgtatatatgacgattgtaaaaaggatgatacagataccgatattctgtatcccaaatacaccatctaacacattgtagattccattcatcaattttccaagcagccaggaaatctgatgaataattggccagtctgcataacctgcagctaaagttccatacatctcttatcctccttaaggtaccggatcatatccgccttttgcaaatggattgcagcgcagaattctccagattgtgagggcgcctccctttacagcaccgtatttttgaattgcttcaataccgtactgtgaacaagtcggcgtataaatacagtgatactgcgtcttcaatccggacagatacttctgataaaatctgataagccctataaaaatatgcttcatctgcgtcacttccctttatatatttcatgaagctttcccaagtggataagtgcactctcaatctcatggtaacacttctcttttgcacttactctggctattacgactatatcaagtccactttggaaatgttcttctaaaagccgataactttctcggatcaaccttgtcagatgatgcctgacaacactgttccccacttttttactaacggaaataccgagcctgtttttgtccagcccattttccttcacatacatcacaagatacttattagcataagatcttccgcttttataaacaatttgaaagtcattattttttttcaaagattcggaaaatttcattgaattccctttgcctttttcttttataaatagaagaaaaggccacatagatgcggcctaagctgataactgttttcttccttttgctcttctggcagctaaaacttttcttccgcctggtgtgctcattcttgctctaaagccatgaacttttgctctctgtcttttctttggctgaaatgtcattttcatcgcagatacacctccctttgattgatatacttattataaagtattacaattattatcactttcgcctgccgtctttgttaaaaaatatatacctatataatacacaaaaaagacactgctcttaattatattcaaaaaaaaggggggaagtcaagctattatggggaattttatgcgaaattacggatgtttgggtaaggggggggcgctaaggaagaggtgtggcttgctcctgggggagtgtgtatgctgattcaaatcccgaccgttcacgaagaagatgtaaacgaaaaaacaggtaaaattgagggacttgccgcagttgacccaaaatcttgatgattttgggccgccggcggcaacaaaatttgttttggtaaaacaaattttgccctcaattttacctgttttttcgctaacatcttctaacgcttactttgagggattctgaatcagcatacacactcccccaggagcaagccacacctcttccttagctgggttcatccaatcggcagcattgcggcatggacgttgacggatagcttatagggactttatgcgggggcagtggatctgccctgacgacgcggagctgggatttgtattttatactaagtttcctgtaactcacgttttgacgtgcggggctgttgcatggctactgaataaattatatctatataatttcctataatacctgtcttacagacgggtcacgtatacccccgaaataaattatactcaaaagccccctgtaacctaatccttgcggacggctccccaatacaattaaaaaatattcgatcaaaaaaaccacattaacactccgcacagccagttaccatccgctgcccccgtccgaaccccacccactaagaatcatccctttcctcttgctgcagcacccctcacatccttttatagagcgtcccctcatcctttcactcacaagttcgttatctacattcttatgtggataatatgtggataagtgttggataaggtgttgattaaattttatttttgattttaacccatgcaaacatacgcgtttaaattgttcataaagttatacacatcatttctcattgcttctcataccgttttgatgtaaaatgtaatagagagattttgcgttcatatctctctattatattgattaggagtactgtcgatgaacattgtagttgaaaattgggagcagattttaaacaaaatgaaggacgaatattgctcatctaatatttcatacaatacgtggattgcgccgcttactgtatatgaagttaccgatgacactgtctatattctcgtaaaactaaaagccagcctggaacatatagaagagaaatatctccttccttttaaagtgtgtattgcagaagttacaggcactgagtttgaaatctcttttgttactgaagataatgtcatcatccaggaaaagaaagaaaatgtcataaagaataaaaagtcaaatgctatctttgagaatgcgaatctcaatgccaaatatacatttgatacttttgttgtgggcagtaataataatttcgcacatgctgcgtctcttgcggttgcagaatcacccggggagatttacaaccctctttttatatatggaggtgtcggactggggaagactcatctgatgcattcggttgcacactttatacttgagaatgacccttccaagaaggtcctgtatgtgacaagtgagacatttacaaatgaattgattgatgccttaaaaataggtaaaaacggcaatgaacttgccatgaccactttccgtgaaaaataccgaaataacgatgtgcttctgattgatgatattcagtttataataggtaaggaaagtacacaggaagaattcttccacacgtttaaccatctccatgtgtcagggaagcagattattatctccagtgataagcctccgaaggatatcgagacactggaagcacggctccgcacccgttttgaatggggcctgattgcggatatttcctcacctgattatgagaccaggatggccattctcagaaagaaagaggaactggacggactggaacgttatcacattccggatgaagtactccaatatattgcaaataatattaaatccaatatcagggaactggaaggctccctgaacaagctgatcgccttatccaatctggagaagaagccgatcgacattcctctggccgcagaagcactgaaggacatgatttcgcccgatgcaaaccggacgattactcctgaactgattatcgatgttgtttccgaacattttaatgtccccatttctgaattgaaggggaagaaaagaaatgctgagattgtacttccacgtcagattgtaatgtacctctgccgtgccatgacggataccccccttaagactgtaggtattatcctgggaggcaaggatcacgcttctgtcagccatggagttaagaagatcgcacatgaccttacagttgacgaggctctgaacaacactgtgaacattattaagaagaagataaatcctatttaatgtggataaattgtggataacaatgttaaaatgatgtgaattatgaggttaataaaaaaattaaggagtttgaggagttttttatccccatcttgtcccaacactttccagtggatgtctacacagttttcagtatggacaaccccttaattttaaaggctttgaagcacttatgaacttattcacagcccctattacgaagaagacggaattgatttatatatttatctataaaaaacgcggtggaaagttttttcaccacaaccatcgaaaggagttaccgacatatgaaaatcgtttgttcaaaatctaacctggttaaaggtgtcagcattgtatccaaagctgtaccatccaaaactacaatgcctattctggaatgtattctgatcgatgcatctacagatgtcattaagctgactgcaaatgatatggaacttggaattgagacaagcatcgaaggtgatatcgtagagagaggaattatagccctgaatgcaagaatattttcagagatcgtcaggaagcttcctgacaatgatgtaaccattgagaccgatacggataaccagacaatgatcaactgtgaaaaagcgaagttcaatattgccgcacagtcgggagaagatttttcatacctgcccgtgattgaaaaagaggattacattaccgtctctgaatttacgttgaaagaagtcatacgacagactatcttttccatcgcagataacgatacaaataagatgatgacaggcgaactgttcgagatcgaagagaacatcctgaaggtggtctctctggacggccacagaatctcgatccgtaagattgagttaaaggaaaactatgcgccgaaaaaggtgatcgtaccgggtaagacactgcaggagatcagcaagattattggcggagaggcagaggcggatgtagacatttcgtttacaaagaaccacattgtgtttgagtttgataagacggtggtggtatccagactgatcgaaggagattattttaagattgaccagatgctctccagcgattatgagacaaaagtaagaattaacaagaaagagcttctggactgtattgacagagccacccttttgatcaaggagggagacaaaaagccgattatcattgatatccgggacgaatccatggaacttaagatcaagtctcagattggatccatggatgaggaaatctttatcacaaaagaagggaaggatctgatgatcgggtttaatcctaagttcttgatcgatgccctgagagtcattgatgatgaggaggttgacctgtattacatgaatgcaaaggcgccatgttttatcaaggatgaaaaacagagttatatttatttgattcttccggttaactttaatgcggtgtaatagctcaggcctgtctgaaatgttacaacgcggttgcataataaatggggacgtggcccttttatccagatataaggcacggtggtttcaggccgggataaaagggcggcgtccccaatggggttatcgaaaggacagaaaggacttggtatggagattataaagttacgtgaaagcgatgaatttattaagctggggcaggcactgaaagcggccgggcttgtggattccggagtggaggcaaaagaggttgtccaggacggattggtaaaggtgaacggggagacggacaccagaagagggcgcaaattatacgttggggacagggtggaatttgacggccaggaaataaaaattgaaaaatagtctgaaaaagtgtaaaataattgtgtcagttcagataggtctgcgcatttactgcgcagactgtacggaaaaaatggtggttgcaggcatacagcgctttgccgcaggttaatttctatgggctggatgcgtaacagttcaggcaggcctcaactgttactaataattacatgctgatggagaaattatggtaatcaaatctttaaaactaaagaattacaggaattacgaattgttggatttgacctttgatcccaagacgaatattctctacggcgacaatgcacaaggcaagacgaatgtactggaagccctgtatttatccgggactaccaaatctcacagaggtacaaaagacagagatttgattcagtttggacgtgatgaagcacatctggagactattgttgagaaaaggggattagaatatcagatcgatatgcatctgaaaaagaacagtcccaaagggattgctatcaataagattccgatccgcaaagcaagtgaattgtttggaattattcattttgtatttttttctccggaagacttgaacatcatcaaggacgggccttccggaagaagaagatttatcgatctggaattgtcgcagcttgataaagtatatctcagcaatctttctaactataatcgaattattaatcagagaaattccttactcaaagacatttataaacaggagaatcttgtggaaacgttggatatctgggatatgcaattggttgagtacgggacaaaagtaatggagagccggaagcggtttatagaagaagttaatgaaatcatctctgatatccactataaattaactggggggaaggagcacattactctttcctacgaatgcagcgtcggaaaccttagcctggaacaggctctgaagaaaaacagggatagggacatgaggctgaagagcacctctgtgggcccacacagggatgatctttgttttatggcgggcagcctggatatccgcaggtttgggtcgcagggacagcagcggacggcagctttgtcgctgaagctctccgagattgaactggtcaggtcactgatcagggatacgcctgtgttattattggacgatgtattgtctgaactggataaacacaggcaaaactatttactggatagtattcatgatatacaaacggtaatcacatgtactggattagatgagtttgtgaatcatcgattttctattaataaaattttccatgtaaaaaatggacaggtagcaaaagaaaattaggaggtttttaaatgggtgcaacaggtacagaatttgatgctgaatatggagcagatcagatccagatattagagggattggaagcggtaagaaaaaggccggggatgtacatcggaagcacttcgtcaagaggacttcaccatctggtatatgagattgtagacaacgctgtggatgaggcgctggcaggatattgtgatacaatctttgtaagtataaatgagggaaactcaatcacggttattgataacgggcgtggtattcctgtggggatcaatcataaggccgggcttcctgcggtagaagttgtatttacaattctgcatgctgggggaaagtttggcggcgggggttacaaggtatcgggcggcctccacggtgtgggagcttcggttgtaaacgcactgtcgcagtggctggaggtagagatctacaatgagggtaagatctacaggcagagatacgagcgtggaaaagttgtagaaaagctgcgggtggtcggggaatgtgaggctgataagagaggtactaaagtaacatttctgccggatgatgagatttttgaggaaacgatttttgattatgatacattgaagcagcgtttccgcgagatggctttcctgacaagaggactgcggattgtacttagggatgagcgcggggaagagcttgtggagaagaatttccactatgagggcggaatcaaggagtttgtcacttatttgaaccgcagtaaaacagctctttacgaccagattatatactgtgagggaatgaaggataatgtagccgttgaggttgccatgcagcacaacgattcctacagtgacaatacttatggctttgtaaataatattactacgccggagggcggtactcatgtagtgggattccgcaacgcactgacaaaaacttttaatgattacgcgagaaaaaataagctgctcaaagacagcgagccgaatctatccggtgaggatatccgggaaggtctgactgcgattatcagtgtaaagattgaggacccccagtttgagggacagacaaagcagaagctgggcaatagtgaagcgcgcggcgctgtggatagtattgtgagtacccagctggagattttcctggagcagaacccaaatgttgcgaaaatgactgtcgaaaagtcagtgatggcgcagcgtgcaagggaggcagccagaaaagcaagggatcttaccagaagaaagtctgccctggagggaatgtccctgccgggtaaacttgccgactgctcggacaaggatccgaaaaactgcgagatttacatcgtagagggtgattctgccggcggttccgcgaaaactgccagagacagatccactcaggctatcctgccgctgaggggaaagattctgaatgtggagaaggcaaggctggataagatttatggaaatgcagagattaaagcgatgatcactgcatttggcacgggaatacatgaggattttgatattacaaagcttcggtatcataagattattattatgactgatgccgacgtggatggggcgcatatcagcaccctgttattgacatttttatatcgttttatgccggatctgatcaaagacggttatgtatatctggcgcagccgccgctgtacaagctggaaaagaacaagaaggtatggtatgcatacagtgatgaggaactgagccaaattctttcagaagtgggacgtgacggaaacaacaagatacagcgctataaaggtcttggagagatggatgcggaacagctgtgggagaccaccatggatccggaacacagaatactgctgagggtgacgatggacgaggagacttcttcagagcttgacctgactttcactacgctgatgggagacaaagtagagccaaggcgggaatttatcgaggagaatgcgaagtatgtgcagaatctggatatctaatcgtacattgtggggaaagtactgattactgaccagcatcgaataattaagggtttggccgaacggacaatttgtctgccgggaaaccttcaaaggaaaggatataaaaatggaagataatatttttgataaagtccatgaagttgatttgaaaaagaccatggaaaattcttatatcgattatgccatgagtgtaatagctgctcgtgccctgcccgatgtaagagacggcctgaagcctgtacagagaagaattctgtattctatgattgaattgaataacgggcctgacaagccgcaccgtaaatgtgcgcgtattgtcggtgatactatgggtaagtatcacccgcacggcgacagttccatttacggggcgctggtaaatttggcccaggaatggtccaccagatatccgcttgttgacggccacggtaactttggttctgtggacggtgacggcgcggctgccatgcgttacacggaggcacggctcagcaagatttccatggagatgactgcggatatcaacaaggatactgttgattttacaccgaattttgatgagacggaaaaagagccgaccgtgctgccagccagatttccgaatcttcttgtcaacggaacatccggtattgcagttggtatggctaccaatatacctccccacaatctgagagaagttatcggtgcagttgtgaaaatcattgacgatcagattgaagagaacggcgacacggccattgaagatattttaaagatcattaagggaccagattttccgacaggtgcggagattctcggaacaagagggatcgaggaagcatacagaaccggacgcggcaagatccgtgtgcgtgcaattacgaatattgagcctatggcaaacggaaagaaccggatcattgtcacagagcttccctatatggtaaataaagccagattaattgaaaagattgcagagcttgtgcgggataagaagatcgatggaattacagacctgagcgaccagtcgaaccgcgaagggatgaggatttgtattgaactgcgccgggatgtgaatccaaatgtcattctgaatcagctgtacaagcatacacagctgcaggatacatttggcgtcattatgcttgcgcttgtgaataatgagccaagggttatgaatattctggatatgcttcggctttatctgaagcatcaggaggaagttgtaaccagaaggacaaagtatgaactaaacaaggcagaagagcgtgcacatatcttaaaaggcttacttatcgcgctggatcacatagatgaagtcattaagatcatcagagggtccaagaacgtccagattgcgaaagaagaattaatcgcaagatttgacttaacagatgtgcaggcacaggctattgtggatatgcgtctccgtgcgctgaccggtctggaaagagagaagctggagagtgaattcgaagagctgatgaagaaaatcggcgaattaaaggcaattctggctgataggaagctgcttctcggcgtgatccgggaagagattctgcttatttctgaaaagtacggggatgagagaagaacatccatcggctttgatgaatttgatatatccatggaagatctgattccaagggaaaatattgttattaccatgaccaggctcggatacatcaagcgtatgaccatggataccttcaagagccagaacaggggcggcaagggaattaagggaatgcagacgctggaagaggattatatcaaggaattatttattacctccacccatcactatattatgttcttcaccaatacagggcgtgtatacaggatcaagggatacgagattccggaggccagcaggaccgcgagagggaccgctattattaatatcctgcagttgatgccggatgagaagattacggctatgatcccgatacaggagtatgaggacggtaagtttttgtttatggcaacagagaaggggcttgtgaaaaagactccgattaccgattatgcaaatgttagaaagacagggcttgcagcgatcacgctgcgcgaggacgacaggttgattgaagtcaagattacggacaatgaggaagatattgtactggtaaccaaatatggccagtgtattagatttaatgaaaaggatgtccgggcgacaggaagaacttctatgggggtccgcggcatgaacttaagcgacagggatgaagtcattgcaatgcagatgagcactcagggcagcgatctcctcattgtatcggaaaaggggatgggcaagcgcaccagcctggaggaatttacaacacagaaccgcggcggtaagggcgtgaagtgctataagataaccgagaagaccggaaatgtagtgggcatgaaggccgtgaatgaagataatgaaattatgattatcaatacagagggaattattattcgtatgcagtgtgcggatatatcagttctcggacgtgtgacatcgggagtaaaactgattaaccttgccgagggggataccgtggcgagtgtcgctaaggtaagaaaggcatctgctgagattgatggagaaaaggtagaaatctctgaagatgatgaggagattcaggaataaactaatggctgaagggacgctttccggagtcgtgaaagggatatcctggatgcggcattcgaagataactgccgctaatcaaaagaaaagccagcatgatgaacaccgccgacaaacacgggaatgcaggatgcattcccgtataagtcggcttacaagcaggacttgtggtcctgcttgtagttcatatgctggcttttcttttgatgaagcggcagtaatctccgaatgaagcatccgggatatccctttcacgactccggaaagctggtgcatcaggacgggagagttgaattcctgggatggctctctgcgccggcaggggcgggggaggcggattgttaatggattcatggatcgattcgttattggtaataatgtttattgagtgagattatattcagttatatatttttagtgtggggtttggtatacttaagaaaattggaatagtatttgtgggttttagtttattggtgagggataatgaagaaaataattatgttcgtgtttctagtaataacaataattcttttttctggctgcagtaaatatgatgataatccgaaaaattctgcggcaggggcgctgtctgaggaaaacgtaatcaatcgaatttcgggaaaggttatggatatcaggttggggtacaggaggggcagatagatttatttattgatgacaaatggatcgtgtttgaattattagaaaatggaacagattatacaaggcaggattaatctgtgtttgatatattattttgtgtgaaaaagtgtataattagtaaatgagcttcctgatgttgatgcttttagaatcatattatgagagtactcatttagggaaaggaggaaacgtcatgcgtttaagcctaaaaaagcgagggttgtttagtgggaagattctttttgaaaaggtgattatgttttttctgtatcgtggaatgaagactttatataagtatgatagcagagtctacaaagaaattgagagctggccgatgggaaggacgattgttctgactgcatcaaaaagggggccaaagctttgtttagtaagagtatccagtggtatagtgcgttccggaaatattgaggatccggatattctaatttcatttaaaagtattgacggtgcatttctggtattttccggacagatggggattacagaggcttatgctcagcatcgttttatggtgaagggggatattgccgagattatgtctattgtaaggtgtattgaattggccgaagtatatttgtttcctaaaataattacaaaaagaatactgcgtagagtacctggtaaacaactgggaagttttcgggtatattgccatttattattggaattttagaataaagactcaagtaaactttttgagtattcatggcgggctgtcattatgcttcgtatgactgatttctttggcgcaccgattcgatctgggggtatatatatcttattgtaaaataaaagttatcaacagttatattactaaaaaacggagtaattcacataaagtatgtggaaaacactggaaaaatgtggaaaagtctattttatttgaaattttgatgagatttaggaggaaaacttgtgctgccaacgtattatgaatttcagaattcaacaaaaattttatcaggaaagtatgcgcttgaaaacattacctacgaactaaagggactgggggcgtgcaggccgattttgttatccggcaggattctcgagaaagtgggatctctaaaaaaggtgatcaacgcaattgtttccacaggaatggagccgggggctatttttacagatattcctgcagattcttcggtcgaggttgtgaatagaatcgggaaaacatataaaaaagcggcctgtgacagtatcatagctgtaggaggaggttctattatagatactgcaaagggcctagaaatgctgatatcccaggaggcagaggatttgctggagctgcagggctgcgagtccatgattcgaggaaaacatatcccctttattgcagtgccgaccacatcggggaccggttcagagacaacacttgtagctgtgattaaaaatatagaaaagtccgtaaaaatggagtttatatcaaactatctgttaccggatgcagcggtactggatccccgaatgacagaaacgcttccaccgaaaacggcagcttcgacaggttttgatgcattatgccatgcaatagaagcattcagctgtactcaaaaaaatccactgagcgatgcctatgccgccactgcaataaaactgatttcagagaatctggtgaccaccataaaaaatgggaaaaatattgaggcaagacttgcaatggcaaacgcatccactatggctggtgcagcattttccaattccatggtaggagtagttcatgcaatcggacatgcactgggtggagtctgtaaagtaccccatggaaatgccatgttcatattgcttccatattgtatgttatataattataaacaattgggagatatatacggagaattacttttatatctggaggggccggaagtgtacgccagaacttctgcagaaaagcgaagtgaagaggccataaaatccgttagaaaactcgaacgcagacttcataagttatgtggactgcccatgacactaaaagaagtaaacgtggagaaaaaagattttgatgcagtggcaaaaacagcactgaatgatggggctatgcttttaaatccggctgcagtggattatgaggacgtcataatgatattaaaccaggcttacgagtaaaggggtctgacccctttgcttaccattttcagaatattcttaaaattcatttgtttttagaaacgtgcaatagaaatgcaattaatagacgggtacgaaatgctttattgaaataaggcaggaagtattcgttttttttatcttataggaaagttcgcctataagataaacaggccctcctgcggggatgcgcactgcggcgtaagaggcagatgtcgcgatgcggccgccgcaggcgcgagttttgcaagcgaaactctattttattttaaatttataatcaatttactcctgttataagcaattacctaagtattaataagtaagctgtaagtaaacagtattcttcagggatttagatctccgagtttcatagccttcttagtctacaacttagctatatatactttaaattaataaaaatatatcgttattcaataaaaatatattgaaatacagtttcggtaatgatataatccattaaaagaactattggaaaattacacagaatttggaaaggattgaattttatgaagcaggaaaagctgatcagatttacaagtggttttttaggttttatgttttatgcaggaattatcgtactgttgggtctcccatttatattaaaagtggcaggcaggtattattatgcagaaatagaagtacaattttggcctatgttaattactgttgctcttgcaggtgtctgtggccttaccattgtgcaccagctgagaaggatgataaagacagtgattaaaaaagactgttttgtggataacaatgtaaaaagcctgagtatgatgggaaaagtaagttttattatttctgtgctatttgtaataaagttattttttctgcccactcctgcaacgtatgtcgttattctgaccttttttatagccggactgttcagccatgttctggcctgtgtttttaaagaagctgtacgttttaaaaacgaaaatgatctgaccatttaagtggaatatattacaggaggaaaaggatgtcaattatagtgaatttggatgttatgatggcaaaaagaaaaataagcgtgaccgagctggcgcaggagatcgatattacaatggccaatctttcgatattaaaaaataataaagcaaaggccgtcagatttaccactttggacgctatatgcaaggctttaaaatgtcagcccggagatattctggaatatgtagaggaggaagattagccggagcgggatctgatgttgacgaaaactttcagtaaatcaggaaaggagcatttactatgggaacattatcagtcagtaaaatagaagagaattatctctatacaggatgtatgtgtgggatctacggttttatatttactttctgtctgtataagaatctgtcaggagttacattccctgtcattgttgcagtaacaattgctacagcgtttatgtttttgaaaagaatgggaataacaataaagaaaaatttttatatttacgcagctgggatgctgctgctgggaatttctactccgctgacaatgagtaaattttttcatttttttaactggattggaattatactgctttttatgtctggaatgattcaacaggtaaacgagcagggaaactggagctttcagaagtatatagtatctattctgatgctggcgggaaagacgattgcttctgtgtgtgatcccttaattcatggaatcagatacaggaaaaagaggggaaaaaaagaaagcagatattttaaacctattattcttgggtgtgcgtgtgcagccgggctgttagtaattgtccttccgcttcttgtaaattcagacaaaatttttgcggtgtttttcggccgttttacgggatggtttagatttggggctgagctgggagtaattctgacatttctggcgggctatattctgatgtatgcatttctttcaggaatatcagcactgaatataaaagagaaagaaaatgtaaaacagctttctttaaattctgttacagggattacattttcagggatacttgccgttatatatgtattttactctgcgattcagatattatttttgtttttacggtttgaaagtggtctgccagagagcgtcacatattcacagtatgcgcatgcgggattctggcagctactggcggtcagcattattaatttcatcactgtgttaatctgtgttagtatttttgaagaaaataaaattttgaaaattattcttatgataatttcagtatgcacatgtattatgactctttccgcagcttacaggatgattctttatgtaagagcctaccatcttacttttttaagagttctggttctttggttcctgggggtgcttctgctgattatggtgggggttatgctgagtattatacgaaagaagtttcaattattcaaatatatcatggtcgtgctagcagtctgctatattgcgctgtcatttgcaaaagtggataaactgaccgcacaatataatgtcagacactgggatcagatttcggaggtagatatgatgcaccttatgtttgccaactctctggataccgcgccagttgtggttcaggctgctgaaaaggcagtgggtgatccggaatactgggatgggaggctgaaacagtattttcagtggattcaagaacaggatatgtccctgagaacctggaatttttcaaaagccagcgctaaggaagcagcagaagaatatctgcgttgacgttgaactgcctttaaaataccttattttgcgtctttactgaaggtctgcccttcttccatatcaatatttttatttacaacagccagtctatttaaattcatgaaaatctgtaacagttcaggcaggcctgaactgttacgaaatcctcccaattttgagataagtttattacaccactattttcttttttataaaattatattataataagaaaagttgtgaattaaaataaatgaaataattaaatagtacaggaggagtcatggtacggtcaattaatgttgaggaaatcgctaaaaatataaaagaaatgtgtattgaagcaaatcactatctgtcaccagacatggatgcggcgatgaagcttgcagaacagacagaaaaatcccctcttggtaaacaaatactgggacagcttcaggagaatctggagatagctgcgcaggatatgattccaatctgccaggatacaggcatggcagtgatatttctggagattggccaggacgtgcatctggagggcgggcttctggaagatgcagtcaatgaaggtgtgcgtcagggatacacagaaggttttctgagaaagtccgtggtaaatgatcccttaatccgtgaaaatacaaaagataatacacctgctattatccatataaaaataacagcaggagacaaagtaaaaataaaagtagcaccgaaaggattcggaagtgaaaacatgagccgagtcttcatgttgaaacccgctgaaggaatagaaggtgttaaaaaagccgtgttaacagctgtaaaagatgcaggtcctaacgcctgccctccaatggtagttggtgtaggtatcggcggaacattcgaaaaatgcgcattaatggcaaaagaagccctcaccagggaagtaggaacacattccgatatcccatatgtaaaagaattggaagacgaattattaaagaagataaacgggctgggaattgggccgggcgggctaggaggaaccaccacagcactcggggttcatatcaatacctatgcaacacatattgccgggctgccggttggagttaatatctgctgtcatgtgaacagacatgtagtccgggagctgtaaaggggtctgacccctttgcttaccgttttcagaatattcttaagatttaccagggagggatatatattatggataaacatatcacagcgccgattacgaaggaagtatcaaaatctctgcatgcaggcgactatgtatacataacggggacaatctatacggcccgagatgcagctcataaaagaatgtatgagatactgggagagggaaagtctcttcctataaatattgagaatcaggtgatttactatatgggaccttcacctgcaagggaaggacgccctatcggttcggcaggtcctacaactgcaagccggatggataaatacgcacctcagcttctggatctggggctcggtgctatgattggaaaagggaaaaggagccaggaagtgattgacgctgttataagaaatgattccgtttactttgcagcagtaggaggggcaggtgcacttctttcaaaatgtattaccagctctgaagtagttgcctatgatgatctggggactgaggcaatccgcagactgactgtagaaaattttcctgttatcgttgtaattgatagtgaaggcagtaatttgtatgaaactgctattaaagaatattgtatagaagactaactattgtgtttaatttagaataattatggaaaaactaagagctgagaggaaaatgtaatgaaacgtatattgctgatggtgttccgaaatatcatcctggttccatatatgtggtgccgtctgtgttatcacgcgtcacatactgaaaagtacacggaggaggaacagtacagtcttctaaagtttattgtgctgcgtgcaaataaagggggaaatgtacggatagaaccttacggcacagaaaatattcctaaagaaagtggattcatgttttttccaaaccatcagggtctttacgatgtgcttgccgtcctggaggcctgcccaatgcccttttcagtggtcgcaaagaaggaaattcagaacattcagtttctaaaacaggtttttgcatgtatgaaagcatatatgctggacagggataatgtacgccaggcaatgcaggttattatcgatgtatcaaatgaagtgaaaaatgggagaaattatctgatctttgcagagggtacccgttcaaagaacggaaaccgtataggggaatttaaggggggcagcttcaaagctgcaacaaaggcaaaatgtccaattgtccccatagcgctgattgattcattccgcccattcgatacaaatacaatcagtaaggttaccgtacaggttcatttcctgaaaccattgtactatgatgattataaaaatatgaaaacaacggaaatagcatctattgtccatgacagaatacaggatacaattgacaaaaatgagaaaaaatgaaaaagttgcgatttagccgttgacataaaacaatctgtttagtataataacttttgcactgttgggtgtataattgtatattgccctgctgatatatagaaagcaggtattatttcagaatcaggagaaatactcaagaggctgaagaggcgcccctgctaagggtgtaggtcgggtaaccggcgcgagggttcaaatccctctttctccgttttgatgttttccagaactactgggccaagccagtagtttttgcatgtaagttctacagatgttattgtgggaaagcattactaaaaacactaaatctagtatgtaaaatgtgtgtttgaaaaaagttggaaaaaagttaaataaactcttgacagatgcatacgattaatgatactatgtttaggctgacccgtgagggacagcaaacgacaaaaagcaccttgataattaaacaatagacaacaaacccttgaaaatttcttatagaaaaaatttttaagaacagcatcataatgatgcacccatcactgagattaatctcggtggtaagaacagtaaaaagggatagaattagctagtagttaattctgacccggatacaaacacttttaacgagagtttgatcctggctcaggatgaacgctggcggcgtgcttaacacatgcaagtcgagcgaagcgctttacttagatttcttcggattgaaaagttttgcgactgagcggcggacgggtgagtaacgcgtgggtaacctgcctcatacagggggataacagttagaaatgactgctaataccgcataagaccacggtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttaattcgaagcaacgcgaagaaccttacctgctcttgacatccccctgaccggcgcgtaatggtgcctttccttcgggacaggggagacaggtggtgcatggttgtcgtcagctcgtgtcgtgagatgttgggttaagtcccgcaacgagcgcaacccttatctttagtagccagcggtttggccgggcactctagagagactgccagggataacctggaggaaggtggggatgacgtcaaatcatcatgccccttatgagcagggctacacacgtgctacaatggcgtaaacaaagggaggcgaagccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctcctttctaaggaagaaagaagtaaagagtatgttgtctattgtttagttatcaagagagtgcctgaaagggcatgctcacataacaaaatattttggtggcgatgcgcctgggggaaacacccgttcccatcccgaacacgatggttaagacccagacggccgatggtactgcattggagacgatgtgggagagtaggtggccgccaaatctaaaaaagaataacaggatgacggaagcgccgtcagtattatataaatgttgattatatagataccggcaaggataagcaacaacttatcaacgccaacccaatcagcagggcagtgctgttatgatagctggttttaccagtgattagatatacgaaacaattcgtgtatgtaatgactgataaagcagtcagcgggtgggaagcggaagcggaacatctggatatgtaccttgaaaattgcatacaaagagaagttgtattattactgataagcgataatacgacagattaaatatcttatttaatcaagacatccgaggtaatgttaacaacattaactagttcgaaaaaaacgaacggaaaaaattgaattttattgaacattagcagttcaataagaggaacctattgccaacgcatatcacgctagatatgtgtcgcccgatctccaacccgtgagagaaggcaagttggttatgctaataagagcgtatggtggatgccttggcactaagagccgatgaaagacgtgataagctgcgataagcttcggggaggggcaaatacccatcgatccggagatttctgaatggggaaacccactggagcagacctccagtatccttaacccaatccataagttaaggaagggaacccggtgaactgaaacatctaagtagccggaggaagagaaaacaacatgtgattccggaagtagcggcgagcgaaaccggaagagcccaaaccagggtgcgtgcaccctggggttcggaccgcataattgattcatggaagatagcagaacagttttgggaaagctggccagagagggtgaaagccccgtaagcaaaatccaacatgacatggcggtatccagagtaccacgagacacgagaaaccttgtgggaagaagcggggaccaccccgtaaggctaaatactccttagtgaccgatagcgcatagtactgtgaaggaaaggtgaaaaggaccccgggaggggagtgaaagagaacctgaaaccatatgtttacaaactgtgggagcactttatatgtgcaaccgcgtactttttgtagaacggtccggcgagttacgctggctggcgaggttaagggccgaaggcccggagccgaagggaaaccaagtctgaatagggcgaatatagtcagtcggagtagacccgaaaccgggtgatctatccatgtccaggttgaagttgccgtaaaaggcaatggaggaccgaacccacatccgttgaaaagggtggggatgaggtgtggataggggagaaattccaatcgaacccggagatagctggttctcctcgaaatagctttagggctagcctcatactcaagtcttgcggaggtagagcactgaatttcctagggggcgtcaaagcttaccaaagaatatcaaactccgaatgccgtgtagatgatgtatgggagtcagactgtccgagataagttggatggtcaaaagggaaagagcccagacctacagctaaggtcccaaaatgtgtgttaagtggaaaaggatgtgggatttcgaagacaactaggatgttggctcagaagcagccatccattgaaagagtgcgtaatagctcactagtcgagaggtcctgcgccgaaaatgtccggggctgaaacacactgccgaagcttaggaattgatgaatgtcaattggtagaggagcattcttaactgcggcgaagctgtaccgtaaggagcagtggagtgttaagaagagagaatgccggaatgagtagcgagaggaaggtgggaatccttccggccgaatatctaaggtttccagagtaaagctgatctgctctgggtaagtcggggcctaaggcgaggtcgaaagacgtagtcgatggacaacaggttgaaattcctgtacttttaactgacagaactgtggggacgcagagagaaagcgcaagccggaagtggaaaatccggtgcaagcgtggtaggagcatatcaggcaaatccggtatgcaatccgaagacgtgatgcggagcgaactaaagtagcgaagtgcgtgagctagctgccaagaaaagccgctattgttcagttaaaacccgtaccgtaaaccgacacaggtggatgaggagagaatcctaaggccgacgggagaagcattgttaaggaactcggcaaaatgaccccgtaacttcgggagaaggggtgcctcgcgagaggccgcagagaattggcccaagcaactgtttagcaaaaacacaggtctatgcaaaaccgaaaggtgaggtatatgggctgacgcctgcccggtgctggaaggttaaggggagaggttagcgcaagcgaagctttgaacttaagccccagtaaacggcggccgtaactataacggtcctaaggtagcgaaattccttgtcgggtaagttccgacccgcacgaaaggcgtaatgatttgggcactgtctcaacaatgcacccggtgaaattgaagtaccagtgaagatgctggttacctgcgccaggacggaaagaccccatggagctttactccagcttgatactgggattcggtattgcatgtacaggataggtgggaggctgagaacttatgacgccagtcgtaagggagccgctgttgggataccacccttgcagtattgggtttctaaccatcagccgtgatccggctgggggacaatgtcaggtggggagtttgactggggcggtcgcctccgaaagggtatcggaggcgctcaaaggtcttctcagaatggttggaaaccattcgcagagtgcaaaggcagaagaaggcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgaagtaggtcccaagggttgggctgttcgcccattaaagcggtacgcgagctgggttcagaacgtcgtgagacagttcggtccctatccggcgtgggcgtaggatatttgagaggagctgaccttagtacgagaggaccgggttggactggccgctggtgtatctgttgttctgccaagagcatagcagagtagccaagccgggaagggataaacgctgaaggcatctaagcgtgaagcccccctcaagatgagatatcccataacgtcaagttagtaagaccccttgaagacgacgaggtagatagggcagaggtggaagtgtggcaacacatggagctgactgttactaataggtcgagggcataaccaagcagggtgataggataatggatggatttaattctttgtatgcagttttgaagatacatatcttcatatggcccagtggctcagttggttagagcgccgccctgtcacggcggaggtcgagagttcgagtctcttctgggtcgttgcttatttaccgtataggcttttaatctggtaaatagcattaattttgtgggatcttagctcagctgggagagcatctgccttacaagcagagggtcataggttcgagccctataggtcccacttaacaagaatggatggattcccgagtggccaaagggggcagactgtaaatctgttggcgacgccttcgaaggttcgaatccttctccatccacttgagaagtaattctcataagccgtaaggtttgtgctgatgtggctcaattcattaagattgactaagtcaatcacaagcagagtgctgattacaaatcagtcgctttgagaagatgtaattatgccgatgtggctcaattggcagagcagctgatttgtaatcagcaggttatcggttcgagtccgatcatcggctttatctcattagagataagaaaaatttaatagcgcggggtggagcagtctggaagctcgtcgggctcataacccgaaggtcgtaggttcaaatcctgcccccgcaactcagactttttaagtctaatgcccagatagctcagttggtagagcagaggactgaaaatcctcgtgtcgctggttcgattccggctctgggcattttctttgcaaaaaagaaagacaacctaatatgggcgtgtagctcaggtggtagagcacttgacttttaatcaagttgtccggggttcgaatccccgcacgctcatgacagagaaatgccgtaaatccttaaatacagagggtttgcggtattttaatttttatgcaaattgtgattatttgcactctgcaggcgcacatctgtcccatttgcccaagacagctaaaaagattgtggtaatcacttaatttatggtaccatataagagagggaatggacggaaaaataggacgtagaaatgtaatttacggcgttagctgaagtataggagcatgaatggataatttatataagaaattgcgggattacagccgttcggattattatggatttcatatgccggggcacaagcggagaggaatcctgacgggttgtgacctgccttattcaattgatattacagagatagaaggttttgatgatctgcaccatgcaagaggtatactaaaggaggctgaagagcgtgctgctgcattgtatcattctttggagacacattacctgattaatggaagcacaacagggatattgagtgctgtaatgggttgtacggcaaaaggggacagaatattaatggcaagaaactgccataaatcagtttaccatgcagttttaatgcatgaactgagaccagtctatatttatccggaattttatgcagatgtggaattaaacgggcctgttaaaccaaaagatatagaaaatgccttggataagtatgaggatatcaaggcggtggtaatcacctctccaacatatgacggagttatatcggatataaaatctattgcggctgtggttcacaggaaaggaattcctttgattgtcgatgaggctcatggagcccatctggggtttcatccgtattttgcgaaaaattcagtgtcccttggggcggatgtggttatacacagccttcataaaactcttcctgcgctgacgcagacagccttaatccatatcaataaaaataagaatttaaaagaaaatctggatatcagcggggagattacgcagtatctgcatatgctgcagacaagcagtccttcctatgtactgatggcaggtatagatgaatgtattgagatgatgtcctatggaggacatatgtatcttgataaatatgcagtattattacagcagacacgtgaatcgctgcagaaactgaactgtttaaaactacttgaaacagaattatatgataaatctaagatagtgatttcagtaaaagggactggtataacgggtcggcagctctatatgactcttttggagcgataccatcttcagatggagatggcggccgggtcttatgtgattgccatgacctcaatggcagacacgaaagagggcatgaagcgcctgacggatgcgctgctggaaattgacgcgggcctgtcatctgaaaaaaagttgtctgtagaatttttacttcctccgcttaggcagatatatacgagtgcagagaccaaagaagctgtgggaagaggaagcggacgaagaactcaaagcctggaatgggggaaatctgttggaaaagtttcatcagaatatgcttatgtttatcctcctgggattcccttaattgttcccggggaagagatttctgaagaagcagcagctttacttgaaaaataccgggatcagggattttctgtggaaggtatgaaagaagaaggtaaaattgaggtgttgataaatgggtaagatatgttacattatgggcaaaagttcctccggaaaagatactatttttaaaaaattgaaggaaattctgcctcagttcagaacaattattctatatacgacaaggccgatccgggcaggggaaacgaatggggtggagtattatttcactgatgaggcaaagctgaaaattttggaaaagcagggggctgtaattgaaatgcgagcctatcatacaaaatgcggggtatggaagtattttacggcagacgacgggcagattgatctggaaaaatatcactatattgttattgggacgctgcagtcttatgaggaaatgcgccggtattttggggaggacaggctggtacctgtttatatagaagtggaggacggggaaaggctctcaagggcgcttatgagagagaggcagcaaagtgagcctaagtattccgagatgtgcagacggtttctggcagaccaggaggatttttcagaagaaaacctggagaatgcaggaattatgaagcggtttcaaaataataatatggaagaatgtattcaggaaatacagatgtatctggagagagagatggaggagggatagtttatttaaagaaagagggagaaacagattactctgcttctccctctgctactatatcctcgagtacacgaatcaggtcgtgaatgttctttaattggacatttctttcgagtatacagtctttcaagttgatcggtaatgattcaaacttgtcccggagttccggtgctatataagatgccatattctcacctcggtataggatgtccggatcggggataaattatgagttaataataaaaaaatgagtgacagtttaaaaaacatttcatgccttatttgggacaatacagatgttagacggagaaaatctcctttccctttatttttttgattttggcgcgttttaaggacattgaaaagtgttttatggactcagtgtgataaaagttgtttcttaaaaaataattcgttaataaattattttactgtgataggccagtgataaattctcgaagaaatcccgtatttatgggctatatcttcatgaaaatttatgatatacttaatgagtagttcacaactttgtaagaaacctatagtacaataaacgtaactgttcatactttgaacaaatgcagtaaccagatggtaaattacaaaggaatacggagaggcagcaggtgatgtaatgagcggttttaaggatgtagttggacacaaaaatatcatacaatatataggcaatgcagtgaagacggacaaggtatcacatgcatatataatgaatggggaaaaaggggcaggcaaaaagctgcttgctaatttatttgcaatgagcctgcagtgccagaaccgggaggaagacggagatgcctgcggcaaatgtcagtcctgtaaacaggcgatgaatcataatcagccggatatcattaaggttacgcatgagaaaccgaatacgatcagtatcgacgatatccgtgaacaggtaaataatgatattgtgatcaaaccatacagcagcagatataagatatacattatagcagatgcggatatgatgagtgtacaggcccagaacgcgattcttaagactattgaagagccgccggaatatgcggttattatgctgcttacggagaatgcggagacgctgcttcccacaatcaggtccagatgtgtgatgctcaagctgcggaatattaaggaccagcttgtaaaaaagtatttgatggaacagatgcaggtgccggattataaagcagatgtctgtgtggcgtttgctcagggcaatatgggaaaggccattatgctggctacttcggaacattttaatgagattaaggaagaagcggttcatctgctgagaaatatcaatgatttggatctgaatgaactgattgaggcagtgaagagatgcatgtcctataagctggagatcacggattacatggatgtgatcgcagtatggtacagggatgtgctcatttataaggcaaccagaaatgtggacagggttgtattttcggatcagctgaagtatattaaagaacgggcgagcaagagttcttatgagggaattgagattattctggatgcactggaaaaggcaaagtcccgcctgaaggcgaatgtaaactttgaattgactatggaattgcttttattgacaataaaggagaattaacgggatgacgaaagtaataggtgtgagattccgcactgcaggaaagatatacttctttgcaccggggaagtttgagatcacacagggtgacaatgtaattgttgagacagcgagaggcgtagaatacgggcgtgttgtaagcgggccaaaagaggtgaaggacgaggaagttgtgcagccgctgaagtcggtgatccgtgtggctactgagcaggaccgcaaagtagaggagaagaaccgtgagaaggaaaaggatgcctttaagatctgtctggagaagatccgcaagcatggcctggatatgaagcttattgatgcagaatatacatttgacaataataaggtgctgttttactttacggcggatggcaggatcgatttcagagaactggtaaaggatctggcagcagtattcagaaccaggattgaactccgtcagattggtgtgagggatgagacaaagatccgcggaggaatcgggatatgcgggagacctctgtgctgcaatacttatttatctgaatttgctgcagtttctataaagatggcgaaggaacagaatctgtccctgaatccgacgaagatatcgggagtttgcggccgtttgatgtgctgtctgactaacgaggaagagacatacgaggagctgaacagccagctccctactttgggagataccgtgacaacgccagaggggctttcaggaacggttcattcactgagcgtactgcggaagcttgtaaaggtaattgtggttctggaaaacgatgaaaaagagatacgcgaatacagagctgaggaactgaagttcaggccgcggcgtaaaaaggcaaaagtgtccaaggaagagatgaagaaactggccgcgctggaaaaaggtgaaggagcatcgaagttagatgacaactaagttaagaccgggagagaggctggatgatctccagctggacggatatgagattattcagaatccggagaggttctgttttgggatcgatgccgttttgctctccgattttgtaagagtaaaaaaagaggagacggttctggatctgggaactgggacgggtatcctgcccattctcctcgctgcaaagacgcggggaaagcattttacggggctggagatacagacggaaagcgcggatatggcggtgagaagtgtggagcacaaccggctgggagaacggattgatattgtaacaggagatatcaaagaggcagcggagatatttcggcctgccttttttgatgttatcgtgacaaatcctccgtatatgctggcggagcacggacttcagaatcccagggatgccaaagccattgccaggcatgaggtactctgtacgctggatgatatactgcgggagagcggaaagctgctgcaggagagcaaaggcagattttatatgattcacaaaccgtttcgtcttgcggagattattattaagatgaatcagtataagatcgaaccgaagcgtatccagtttatccacccgtatgtggataaagagccgacgatggttctgcttgaaggaatcaagggcggaaagtccagggtaaaaattgaacctcctgttattatgtacaaatagatgtaaccgttcagacttgcccgaacggttaccaatagatagcgggtgagacatctggggctgataaggaggatttatgtcaggaatattatacttatgcgctaccccgatcgggaatcttgaggacatgacgtttcgggtgatacggactctgaaggaggctgatctgattgcggcggaggatacgcgcaatagtatcaggctgctgaatcattttgagatacgtactcctatgacaagctaccatgaatataataagtttgagaagggccgaaaacttgtggaaaaactgctggagggccagaatattgcgctgattactgatgcgggaacacccgggatctcagatccgggagaggaactggtccgaatgtgctgcgaagcgggaatcacggtgacctctcttccgggtgcgtcggcttgcattacggcgctgacaatatccggtctgtccaccaggaggtttgcttttgaagcctttcttcccacggacaagaaggagcgggagtgggtgctggaagaactggagggagagtttcggacaatcattttgtatgaggcgccccacaggcttgtgaaaacgttgaagctgcttctggaacgtttggggaacagacggattaccgtctgcagagagctgacgaaaaagtatgagactgtatttacctcgacccttgaggaggcggctttgttttatggggagcatgagccaaagggggaatgtgtgcttgtggttgaaggccgcagccgcagtgaggctgtccgagaagaacaggaaaaatgggaagcgatgagcattgaggcacatatggaatattatacttccaggggaatggcaaaaaaagaggccatgaggatggtagcaaaagaccgtggagttcagaaacgggagatttacaattatttggaacgttagagataactatattgttaagaatttgcaacagttcaaacctagcttaacggttacgagaattagtcaacatagacagagagattaaaaatttgcattggaattttagaaaattgtaacattgacgatttgggaaggaaagtatagaataaattacaagttcaagaagaccaggcagacgaaggcgtctcatttaaaggaggccctttttcttttaagatttccggacaggacattttggacagacatcgggtaagacagcaggacagacatcaggtacagtcagcaggtaaggcatcttgaagaaacatcggatcaggcatccatgcagagcatgataggagttccggaacatacagcatcagacttggattgaactatgttagggcgtattacattttatgtaatgcgccttttcatgtggtgtgcgtgtttactatacaaaaaaatcacctttccgttataataagcctgttcaagccgagttataacggaaaagtggttatttatgtttttgtaagtagtgaaacttattttggcatataacgtccgccgtctacgccaattacctgaccacactgatgacatccagtaatatcagaggcaaggaagagaactgcatacgctacatcccagggagttccaacctgccctaaggggctaaaagtcttccaatactctaaagtttctggatttgaagtgaatgccggccacggtgaacctgatgtgaaatgtccatcaattggaggagttgcacctggagcaacgcagttgatacggatgccgtcttttgcaacatcctgtgcaattgtctgagctaagtggatgacagcactctttaatgcaccgtatacacactcatcagagtcgtgaacacgtccacaagtagaagcgttatttacaaaattgccatgtccttgtttttgcatgattggtaaaatatatttccaagcattcatacatgataaaaaattaatttcgtaaattttttgccataagtttctatcgagttcgaggaattttccaagagaatcccagccaacaccgtgataaacactgtcgatagcaccatgcagtaaagcagattctgcagcatgagctgtatcttcgtaacttgttgcatcgcatttaacgatttcggcccatggagcacctgcctcaagagcctctaaagcaactttttcacaagattctaaatctcttccagcaattgttacaccagcaccttcctgagcaaatgcgagagtaacacatcttccaatattagaatgtcccccaaataataaaatatttttgttttttaaacctaaatccatataggtaccacctttcataatttagacgatatgtggcggtacacaaggttaattaacgctgatgtgagagcattggaacgggcttaaagtcaaaataaacattgttattattgttttcgctgaaacaatcaacgctaaaacaaacagaatataaatcctcatcaggtctgtgatgagtaattccccaccatagaggaatatgatctttgatataaccaatactttcaatgatggaataaggggttccaataggtctttctaagatagaagactctttttcatcaagaacaccatgaagaaatctttcttcataaaaagtgatatcaattgaaaaatcgtttgtaaaaaaatcattataattatcaattgtaagtccagggcaatgtttgcatacgatataacgcaattcatgaagaaacggaatatcgtggtgaacataacggagactgtcaagtacaagaattgtatcatcatcttcaaccgctaatacacgttttaagtgacggcttaaatcttttcctgtccgctgttcgattgagcgaaatcttgaacggaaagaaattccctgtgcttttgcggatgcagttaagctggtcattgtaaaataatcatttaaagtctgttttgaacgaacaaaggtaccgactccttttcgaaactctaagtatcctgcgctaatcagattactaatcgctttattggaagttgaacgactaacgccatattgctggcagatcgcacgttctgctaaaaatttatcgccaggctgatattcatccgaaagtatacgatcacgcaaaagtatatatagctgttcatataaactagtcgtatttaatacatttgatgtcataggaaaaatgtccttttctttaaattatttgtgagcatgtgaccctaccacataattttattctgaaaagacgaagaagtcaagaggttcatttaagtatgcaaaaaaaagaattatataatataaacaaaaaaatgtagtaaaaaatatgaaaaatagagaaaatgatgattaatatattgacaaataaaacaaagccgagtattataattctaaagatgatatgtggacagaccacatagtggctacacaaaaaagtggacggattaatgtaattaaaaaaaagaagggaggtttggtaaaaaaagggaaaaatattggacaggccacataacaactaaagaaaaggagatgagaaaacgtaatgggtaattcagttgatttcaaagaagacattaaattacgagaaaaattgtgttacacctcaggtaacgtagcagctgtattagttaatacaacattatccagttacttgatgtatttttacacggacatcttaggaatcgcagcatcagcagcggcagcaatctttttattctcgcgtatttgggatgcttttaatgatccattaatgggaatggttgcggatcgcaccagaagcagatggggtacatatcggccatggatattatgggttgctttaccaatgacaatttgcggaatcttatgtttcactgcacctgatttttcctatacagggaaattaatatgggcatgggtaacctacatagcatgtggtatgtgttacacagggatttatattccatatggtgttatgaataacgttatgacgagggatatgaatcaaagattaacattagctacattcagagagacaggttcagatattgcttctatgatcattggtttcacaacaatgccgctcgtacttgcaattggtcatggaaatgaagcaaaaggatttcagggaacaatgactgtttattctttaatcggattagcttgtttagtaatctgcttccttggaattcgagaaagacgtactcctgaaatcagtaaacttacattaaaagaatctattggatctttgaaggggaacaaacctgcattagtaatcatgttagctatgatagtgatgaacggaatcgtaatgtatgaatttagctggttcgtttactatattaaatatttcttacatagaatggatttacagccaattatcatgacaatgattcccggtgttgctcttatttgtaaatttattattaatcccattgcacagagggttggaaagaaaccgatgttaatcgttggcagctgcatttatttgttagatggaatattgttcttagctgccggatcaaatctagtattagcgattatagcatgtgcaggatttggggcaggacttactttcttctttgtaatggtatgggggagcgttcctgatattgtagagtacggggagtggaagacaggagtcagagcacctggtttcctttattctatgggaacattatcaaataaacttggcttaggattttctggtttattagctggatggatgcttacagtaattaactatgttccaggtgctgaacaaacagcggcagtacagcacggaatttacctttcaacaggtattccattagtagttgcaggaattctttgtgtcatccttttcttattctatgatttaacacaggaaaaatataacgagattcttacagaacttgcagaaagaaatgcacaaaaataaatcccttaaagggaaataaataaataaaaggagaaacaaaatgaaaatgaaatcagcattatgggacaaaatcggacatatgtctgtagttgaaatggatgttccagaaccaaagagaaatgaagtaaaaattaagatcgcatattgtggtatctgtgataatgatcctcagatcattaacgggggatatccaatccttcagccacccatgactatgggtcatgagtacacgggaacaatcgttgaagttggagaagatgtaactacatgtaaaataggagatcgagttgtagccaatatgcatgctttctgtggagcctgccattactgccataacggtatggagcacttctgcgagaatatgactttcgctacaggtgcgtttgctgattatgctacagttgcagcaacagcagttacaaaaattccagattcaatgacatttgagcaggctgcattggcagagccactgagtgcagcaattcacggtatggacattctgcagatgtctgctggaaaatcagtaatcatctatggcggagcagctatcgcccagatgtacattatgcttgcccaccgtgcaggagccagtaaaatattcatggtagatccagtagaagagaagagaaaaatggcactcaaatgtggcgcaaacttggtaattgacccagcatctcagagcgtaaaagaagtcgtcgcagaagagacaaatggatatggcgtagattattgtatcgatgtaagcggatctgtagagaatgcagaagagtgtgttgagattgtagcaaaatgtggacgtatcttatatgctgcatcttacgactttggtgacagaccaatgaatttgaacttattcactgcaagatgtgagaaagaattaagtattgtaacatcgcagcagtctccatactcatttgatcgagcagtagctttaatggaaaacatggacatgagacatttaatcacaggaatttatgatttagattgtcttgatgaggcattagaaaatgtatttacaggaaaaacaatccgtgtattaatccgcccttagtatgttggaggtaaaaaagaatgactagagaagaactaatcaaacagttgactggaaagtcaaaagaaatgagattaaatattttggatattgcagggaaatgtgagaacacacatgttccatctgcaagttcatgttgtgatatcgtaacagcactatatttccactttatgaactatgatccaaagaacccgttggataagaacagagatcgtttcattttaagcgcaggacataagagtatggtccaatacgccgcattgaatttacttggtgttattccagatgaaatgattgatacaatcgaacaatataatagtccattagctgggcatcctgtatataaaaaatgcccaggagtagaagcatctacgggttcattgggacatggcttatctattgcagcaggaatggcccaggctgcaaaaatggatggtgaagattacaaagtatattgtatagttggagatggcgagagcaatgagggatcaatttgggaagccgcgatgtcagctgctaaatacaaattagataatctcgttatgattcttgacagaaataggatgagtgcaacatatccaatatccatgccaatgacagactataaagctgcattagagtcttttggatttgcctgcagagaaatcaacggaaacaatatggcagaagttgttgaagcgttagaaacacttccatacgcagagggaaaaccaaacgcaattatagcaaacactattaaaggttatggaattccatttgcaataaataattcaaaatggcatgctgcatattggtctcctgagaaagtagcagaagcaaaaaaacttattgaagaaatggaaggataggtcttatggaacgaaaatcagaaaatatccagcgtgcgattgtacaggaattaaataatatcatggttgaaaacgatcaggtcgttgttgttaatgcagatatagcacttttatttaaagatggaccagactcaatctcttgtccggacagggtgcttgatgtaggtattgcagagcagaatatgattggttttgcatcaggattggcttactcaggaaaaacagtatttacaacaacaattgctgaaatggcagtagcaagagttatagagcagattcgattagatggatgttatccagatctcaacatcaacatgtttggacagggcagaggatttgcttatggtattggtggaaactcacatattattaccgaggactttgcaatgctgcgcggtattcctaatattaaaattattattccagcagatgcaagagaagcaagaaaagttatgcatgaagcattgagtgtaaatggaacaaaatatatcgctatttccagaggaaatacgccaaatgtatatgaagatgactacgagttccacataggaaaagcagtaacaatgagagatggaatggatgtaacaatcattgctgttggtgatatggttgctccggcacttgacgcagtagaaatccttaaagaaaaaggaatcaatgcaagaatgattaatatgcatacattgaaaccgttggatcatgaagcagtgataaaagcagctaaagagacaggcgcaatattaacagtagagacacacaatgttttaggcggtcttggatcagctgtttcagaagttgtttgtgaggaatgccctattccaatgaaaaaaatgggcgctccagaccagttctctaaagttggaccaatgaatgaattaatagcacaccttggtcttgatgcagagcacattgctgctgaaacagaaaaactcattcagagaaaataaaaattaaaatatcgccgtcttatttatttttgccataagtggaaagtccacatgtcaacatttatcatgtgaacaaaaaggagtttatatggaaaatcacaaaatcccattaaaagaaaaattatgttatacatcaggcaacttatcacaatgtttaattaacaacacaatgtcaagcttcctgctgttcttttttacagatatctcaaaaattccggcagcttctgcaagtttgatttttatgatcggtacaatccttaacattattattggaccagtagtcggaacactttctgaccagactagaacaaaattaggatgttatagaccatgggtaatgtatggtggatttgccgtatccattatttctgcattatgttttgttgctcccccattcggaacatcaggacgtgttatttgggcgggtattgcttacgtatgctggatcattgctttctctgcagcatatacaccatacggtgttatgaataatgttatgacagaagatacgatcgaaagaggaacactggctacatttagagaaacaggttctgatattgccggaatggtagtaggcagtttaacactggctttgatcggtttctacggacatggtcaggatacaaaaggttacacaccaatgatgattacttatgcagtatgctctattattttgatcattatctgtgtaaagggaacaaaagagagacttcttccggtagaggagaaatcatctatagcatcttcttttggaacattaaaaggaaaccgtccggcaattatcatttacattgcaatgatcgttatgaaccttgcagttatgatgcagtttagctgggttatgtactattgtacatactgtttaggaaatggagaattaacaggttctttcattagtatgtggtgttttgtagcattcctctgcaaatttattattatgccgattatcaaaaaaatgggtaagagaaacgctatgattataggaagcgcagcatatcttatcgatggaattctctttttggctgcaaaagataatatgattttgaactatgcggctgtagtattcttcggtattggattaacggtattctttacaacaatttggggggctttaccagatgtagtagagtatggcgagtacgtaagcggtatcagggctccaggtttcttatattccttgggcgcaatgttcaacaaagtagggaatggacttagtggcgtagtcgctggtctggtgcttacatttattggatacaatgcagccggagaacagacagcaagtacaattgcgggtattcgcatggcagccggtgtacctttaattatagcaggtctcgtatgtatcatcttatttgtgttctataacttaagcacaaaagaatacaacgaagtggttgaagaacttaataaacgcagagagaagcagtaaattatgggaaggtttgaatatttagaaggagaagttccagatataccttgtgcagccgccgtaaaaacatcaacacatgtgtatgtttctggtacagcagtgtttcaggatgaacagggaaatgtcatttctgatgttaaggatcagacatgtaagtgtttgaataagattgaacagattttgtcaaaatgggacttaactcgtaaagatattgtaatggtaactgtatttgttcgcgggaaagaaaattttatgggtatgaatgaagcatacagaggattctttggtgatgtatttccatcaagaacagcatgtgtgtctgatcttggccatccagatatgttagttgaaatttcctgtgtagcttgtttataagtaaatttagatagccggaggggcatttgagatgatcaaatgcccaatataggaggatatatggaaaaaattacacttcagcaagtgcagacaattgttagaacaatggcaaaaacagcagaagataatgaagaatacttctcagaattagatggcgtaatgggggatgcagattttggagtgtcattagctgctggttttaggagcgtaatgtcaaaatgggacagctatgatatgacatctatcggaagttttcttttaaatgtaacttctgtaattacaagtagcacaggtggatgttcaggtccagtctgggggacacttttcatgagatgcgggatggcatttcgtgataaaacagaaattactcttgaagaggcttcggcaggattaaagagttctattgaagggattatgaaaagaggtggcgcacacctcggtgataaaactttattagatgcttttcaggcaatcgttgaatcttttgataaagcggataaaaacggaacattgatggaagctctcgaggcagcagcagacgcagcttatgaaacaagagaaattacaaaatcatggattgcaaaacgaggacgccagtcatttaccggagagcgtagtattggaacctatgacccaggcattgtagcagtcggtgatatggctaaagcaatcgtagaagcgttaaaagcataaggaggagctcattatgaagaaaattatgaatgatgcaaatgattttgtaaaagaaatgatcgaaggtgtataccttgccaataaagataaattagagtgggtacctgaaattaacacattatatcgtaaaaatattccggaaggaaaagttactataatgcagggatcaggatcaggacatgagccggcacatattatgtgtgtaggcaaaggtatgttggatgcctcttgtcctggaaatgtatttgctgccccaccaatggattttgtatatcaatgtacaaagaaaattgcttctgatgcaggtgttcttcacattatcaataactatcagggagaccgtatgtcatgggatatgggtcgggagatggctgagatggatggcatcaaagttggtgtagtagtagtaaatgatgacgtttctgtagaagatagtttatacaccgttggacgtcgtggcgttgctggtaacttctttgtaatcaaatgctgcggagctgcttcagagaaaggtgcttcattagaagaattggtagcattaggaaataaagtaaatgcaaatgtccgtacaatgggaatggccttatcatcatgtacacctccttcaaaaggaacagcaatctttgaaattgaagatgatgaaatcgagatgggcgttggtattcatggggaaccaggacgtcgtagagataaaatcaaatctgcacatgaaatcgtagaagaaatgttcaaagcagtttctgaagatcttccattcaaaaaaggtgaccgtgtagcattaatgattaatggtatgggcggaactcctatcagtgaattatatattacatacagagaagcagctttaatgtgcgaagaaaaaggtcttactattgttaaaaattatgttggcaactactgtacatcgctagaaatggcaggattctcgttaacattacttaaattagatgatgagatggaagctttacttgatgaaccggcagagattcctgttcgtattttttaatcactaggaggcgtataaattgaaaatagcggttggttgtgatcctaatgcagaaaactttaaaaaagaactgattacctatattcagaaattaggacatgaggtagaagattttggaagtacagatccaatttatgcaaatgtagcaattgctgttggagaggcagtagcttcaaaacagtatgacagaggcatattgatttgtggaactggtatcggagtctgcattgcagcaaacaaagtaaaaggagcatatgcagcattagttaataatgtttatcaggcacagagagctgaattaagtaatcacgcaaacattatgacaatgggtgctcaggtaataggtattgaattaggaaaatgcctggtgaaagagtatcttggccgtacatttgatccaaatagccgatcggtaccaaaaatcaagagaatttatgattatgagggggcagaaggctaatgcagaatcagaaaagaattaagcaattagaactttatgcagcaaaatgcagacaaaatgttatgcatatgattcgtgcaggtggccacggtcatgtaggtggagcattgtcagctattgatgtagtaaccgcgctctattttgataagatgaatgttgatccaaaaaatccaaaaatggagaacagagaccgttttttattatctgcaggacataaatgcttatctcagtatgcagttttagctgaaaaaggttattttgacaaagctatccttaaaagttatgggtcatttaagtcgctgataccaggacatccggatatgcacaaattaccaggtatagaagctaatacaggggcacttggacatggaatgtctattgctgcaggtatggcaatggctgcaaaacaaaacggcagcagctttaacgtttatgttgttacaggagatggcgaattgccagaaggatcaaactgggaagcagctgcagcagcagcaaagtttggtgtagataatttaactgtttttgtcgataataatggacttcaaatcagcgggaaagtaactgatgtaatgaatatggaggatataagtggaaaattcaaatcatttggatggtctgcaattgagattgatggcaataacatggaagaactagttaacacattggataaattaccaattcaggagggaaaaccgacagctgttatcatgcatacaacaaaagcaaaaggtctttatgcaggagaaaataaaccggagtatcatttctggaatccaacagaagaagacttagataaagcagataaagatttagagatgctcgttgcaaaactggaaaaagaactggaggaaaagaggaatgactgaaaaatttgatccaagaaaagtgtttggacaggctgtaacagaagttgcagaacaaaataaaaatgttgttgttctttctgccgatagtggaaaaagttcaggatttggcgactttatgaaaaaatatccagaacgttactatgaatgtgggattatggagcaaggtgttgtaggaattgcagctggaatggcaactgtagggatgattcccgtattctgtgcaatcgctccatttgtaacatgccgtccatatgaaatggtaagaaatgatataggttatatgcgtcaaaatgtaaaactagtagggcgtaactgtggatttacttattcagacctcggagcaacacaccagagtttggatgattttgcaattatgcggatgattcctggtatgacaatacttgcaccacaggatccaaatgagattaaagcagctgtacgagctatgatagaacatgaaggtccggtatatatgagagttggaaatccaaagatttcaaatatcttaccagagaaagaatttgtaattggaaaaggaacagttcttgaagatggtgaagatattacaattatttctactggatcaacaacagaagcagctttaacagctgcaaaagagttaaaggaaagaggaatttctgtacgtgtaattggtatgccgacagtttatccgttagataccaaacttgttgaagagtctgctaagaaaactggtgttattcttaccgttgaagagcattatgcagaaggtggactgggaacacttgtaacggaggcatgtagtgcattttctgatattaaagtatatcgtttaggtgtacctgcaatatatgcagctacaggtagctatccagagttacttcattactatcatatcgatgcggagggtatcgcaggtgaagtaaaaaaagtgttaagtaaatagtaaaagagctgtcgtgcggaaaatttttattaccggtgaagctgcagccgcagcagaataaagtatccatccacataaaaacctaccctatagtgtgctgttaaaaacggcacacttttttttgagataatgaaagtatcaaagggctgcgggatgtttctatgatgactcagaatacgaatgaaagccgggcttacatttgcctgcaagaattttaaaaagctggcgaggagggcgtattacattctatgtaatgcgcctttttatttgcagatttattgaaaaaaatagaatagctgcggaaaaagaaaaagggggctgccccttttttattcgtttttacgaagataaggctgtttagtaaatatttcagtctatctcttttattggacttaaaaaacgcaagataaaataaggagaaataaaaaaagttcgtcaaaatgaacataataatagttttaaacagaataaataatggtaataatgcactagatgatttcgctaaataataaaagttagtataaaaatataataaaaacgaaataaaacagaaaataaatgttgaatatgcacaactgcaatgctagaatgttaaaaaatgaaatcgcgattcattatatgaaatgcaagtcctgcatttttcacttattacctaaaaatgaaatggtgtttcacaatgtgggacaaaggaggaatcatatggaaatatccagaaatacgcaaggtataaaaccatcctccatacggaagatgtttaataaagcattgcagtatgatgatgtaattagttttacattgggggagccggattttacagcttccgaaaatgtcgtagaagcaggatgccgggccatccggcagggatatacaaaatattccgcgaatgcagggctgcttccgcttagaaaagcgattggtgaagccctaaataaagagactgggcagaactatgatgcggatcgtgagattacggtaacagtaggggccatgggggctttgtatctttcactgaaagtactcatcaatccgggggatgaagtcattatatgtgagccttactggacgaattatgtacagcaggtaaagatgtgtgatggggttcctgtattcgtcatatgcagagaagaaaataactttatactggatgtaaatgatctggagaaggcgattacggagaagacaaaagcggttatattaaactccccttccaatccgaccggaggagtgcttgatatgcagagcctggaagcaattgcacagacagccaaaaagcacgggcttgcggtgatctcggatgaggtatacaaaaccattgtttatgatggaacgaaagctccctccattgcatccgtggaaggaatgaaagaacgtaccattgtgattaacagtttctcaaaagggtatgccatgacagggtggagagtgggatatgccgcaggaccggaagaggtgataagcaatatcacgaaactgcaggaaaatgtggcggcatgcgcagctatgcccagccagtatgcggccctggaagctttgaacggcccgcaggattacaaggaatatatggtggggaagtataaggaaaggcgcgatgtgatggtggcaaggctgaatgcaattcccggcatatcctgcagggcgccaaaaggtaccttctatgcgtttgtgaatatcaggaatcttcctttgacatcagaagagtttgcagacaggcttttagaagaaaaacaggtggtggtagttccgggaactgcttttggcgaaggcggagaaggatatatcaggctgtcttatgcaacttctctggaagcgattgaaagaggcatggatttaatcgaagaatttgtaaaaaccctttaacagccgggaggtaacctgaatggacattaatggcgacaggctcctcagggagctcacagaacttgggaatataggatataaagagggcgttggaaccagccgaatggcatactccgaaacattcaaccagggtcgggattatgtgaagcagctgatggaaagtaccgggatgtcagcaagggttgatgaagtcggtaatcttaccggtgtgctgaaaggggaaaccgaaaaaattatatccataggctcccatattgatacagtaccgggaggcggaatctatgatggagccctgggagttctggccgggattgaagcagtaagggcattaaaatcagccggataccgcagcagacacagcatagaagtgattgcatttaccgaggaagaggggaatgtggttggcggcacatttggaagtaaggcgttcaccggacagccgcaggaaacagattcactgcgaaaggcagtcgggtacaatattacggaaacggatatcctaaatgccaggcggaatccggaagattacagatgctatctggaattacatattgaacagggaggtcggctggagcaagagcagatacccattgggattgtacagggcatcgtagggattgcccgatacagggtgactgttgcaggtaaaaccaatcatgccggcagtactccgatgaatctgcgcgatgatgctctggtaaaagcagccccgatgattacgggaatgatggatatcgcccgggatataaactccgatatgacatgcaccatagggcaaatccgggtggaacccggcgcagtcaatgtaatccccgggctggcggaatttatgattgaactgagatgtatggatacacaggatatcaataaagccatccatagatttgaatcagagtttcagagtgagggtattacaattgagaactttctgtggcaggaagccacaaacatggatggagaattgatgaatgtttttcaaaagtgctgccttggaagaaaaacaaacttctgccatatgccaagtggtgcggggcatgatgggataaacatggcattattcacaccttcagcaatgatctttatcccgagtatgggcggaatcagccataatatcagggaagaaagtaggccggaagatatcataaaaggaagtaatatactgctggatgcgattcaaatgattgaccggcagtaatgagggagatgcagtatgaaaataaaactgatcaatccaaatacgacagctgctatgactcagagcattcaaagttgcgcagaaaagtatgtgcgcaaagatactgaaatatatgcggtcaacccaactgtcggtgtaaacagtattgagtgttatgtagacgaatatctggcgatccccggagtattgcgggaagtccagaaaggggagcaggaaggggccgatgcgtatgtaattgcatgctttggagatcccggtcttcaggcagcaagggaaatcacagacaaaccggtggtaggaattgcagaatctgccattgccgctgccaaagtaattgcgccgtatttttcaattgtatctgttctggaccgttcgattaaggtgactgaggatgtggttgtcaattatggagcagaaaaattctgcagatccatccgctccaccggactcagtgttctggaatttggagaaagcccacaaagaggactagatgcgcttctgcatcagagcagacttgcagtgagtgaggataaggcggagtgtattcttctcggatgtgcagggtttgttgattttgtagaaaagataaagaaggaactgggggttccggtgctagacggggttatgccggccgtaaaatttgcagaaacatttgtggaaatggggctctgcaccagcaaaacaaatacatggagttatcccgagaagaaagaatatgcaggttatgatcttgaaacggtaacatggatgccagggaaaccgatgatatgtggtaaataggaggaaatatgtatgagaaagaaaagattgttagcatttgtacttagttgtgtaatggtatgttccgcacttcttgcaggatgttccgggggaagcaaagaagaaaaacagcccgaacctaaagcagaacagacagaggagacaaaagaagaatccggtgagccggctaaggtattggattccggtgatgttaaggtcggtatcagcatcaatgcgctggatgcgattaataaccgccaggtatttgaaatgatgcagaataaggcagaggcagccggttatgaatacgttgccaccaatgcaaacggcacggcaacccagcagtccacggatattgagaacctggttcagcagggatgcaatgtgattgttgttttgaacggcgatacagaagggctgaccaatgcggtaaaagaggcatctgaaaagggtgtctacgtaatcagtgtagaatcaggatatatcccgggtatttctgcttactttgcaaaaaacgattttgccctggcatccgcaatgtatatgatgctggcaggagagatggggtatgagggtgaaattatagcaaccgggcataacgaccatccagctatccgggcaagagtaaatgtccaggaagcaatgctgaaagaatacgcgaatatcaagctggtaaaccgcgtaacaacgggttacccgggaacgacggaacttgcttataacggcgtggaaagcgcactgcagcagaatccggacgttaagacaatttggtgcacctttgacctggaggcactgggagcggcgcaggcatgcgaagcgctgggcaagaaggatatcaaaattgtaggagccgacggagaaattgatgtgctccgtatgataaaagacggaaaatatattattgcgacatccgtagctgatttggaggcaacgaccgatgatgtcattcagacagtggctgatttatcttccggagcggaagtaaagatgttccatgagatgccatttattatgattacagaggaaaatgtagatgaatggattgaaagaacagagtcctatctgaaagaaagcgaataaaaattgtaaagggcgcttgcaggcgcccaatacttaaatacaaaaactgtttcaagccggaaaggagtaaatatggcagagcaggaaatggcagtagaaatgagaaatatcagtaaatatttcaatggcatatgcgcactccataacgtaaacctgcagataaaaaaggggacgatccatgccctgcttggcgagaacggggcgggaaaatctaccttaatgaagatactttgcggaattattaagaaagaacaggggtccgtttatctgttcggaaaagaaatgaacataaggtctgtgatagaagcccaggaacataagcttgcgattgtgcctcaggaactggcattagtagattattttaccgtagccgaaaacatttatctggggcgtgagcaggtaaaagggccgggcctggtatcacgcagcaaaatgtttgaagaagcagaaactattctgaaagaactcaagattcatctggatccaagaacggctgccggtaaattgagtgtttcagataaacaaatgcttgtaattgcaaaagtgctgtcgctggatgcggaagtgattattatggatgaacctaccgcaaggctgggcgttaaggaaatcaaggaatttctggagtacatgaaatacttgagaagcattggaaaaaccattatttacatatcccataaattagaagagatttttgaaatctgtgacgaaatcacggtattgcgcgacggtcagacgatcggaacccatcggaccgccgatatcacggttgaccagctgattaaagagatggtaaacagatcctcggaaagcctggatatcaaaaagaaccataaagaatttggggaagatatcctgaaggtagagggactgtcatgtgaaaaaatggtggcggacgttcatttttctttgaaaaaaggagaaatcctgggcttttatggactagttggttctgggcgtacagagatgatacgcgcggtgcttggcattgatcctataaagagcggtgaagttacctataaaggaaaccgggtcaggtttaaaaatatccgtgaatccatggcggcagggctggtcttaatcccggaagagaggagaaagcaggggcttgtcatgaatctgtctatccgtcagaatgcgtcgcttacgaagctgaaaagattcagtaaagccggatttatgaataagagtaaagaagtggaaagcgcggaaaaactgcgggaggagctacagctctcctgccccggcattgaaagcccggccggtgcattaagcggcgggaaccagcagaaggttgtcctggcaaaatttgtagacatgccggtggatatctttatatttgatgaaccgaccagagggatagatgtgggggcaaaaagtgagatttatacattgatagagaaaatttcagaacggggagcatctgtcattattatttcatccgaaataccggaactgcagtcaatctgcgacagggttgcagtcatgcgggagggccgggttacgggcgtattgggcagtgaagagttccaggatgcggagaccattctgaaatattctataggaggctaatatgacaggacaggtgcaaatgaaaaagaaagtgcatttttcagaatttgtgatgaaatacgggacattgatgtttttggtgcttctgtgcatcgcattttcggtattacggccaagcacatttttaagtgtgggcaatctattgaccgtattgaggcagattgtaatcttgagcatactgggcggaggccttacggttgttatgatcacaaaccgtatcgacctgacgataggctatacgaccagttttcttggaattgttgcaggtgcgctgatggtagacttcggaattcctgttctgcctgccgcaatcctgactttgatagcgggggccatactggggagcctgagcggtattgctgtggcattgattgggattcctgattttattgcgactttatcattgggatttttgatttcaggctttaaccagtcctatacaaaaggacatccaatctcagggctcccggcggagttcagcatattcggcgctaagtttgttaaaggaataccgacttccatattctttatgatcgtatttctggttattatttttatactgcttaacttcacaagattcggaaggcatgtttatgcaatcggcggcaatgaagaggcatccctgatgtccggtgtaaatgtaaaggcgaatttgatctgggcttatgttgtcagcggcgttggcgcaggactggccgcattgatcctggcgtctaagcttggaaccgcacatcctacggcgggagataattacctgatggaagcgctggccaccgtctatgtggggggaaccgcatttaagagcggggagcctaatattgcaggaacctttgtgggcgctatgattatcggagtccttacaaatgggctgaccctctgcaatgttcagtattacaaccaggacattgcgaaagggcttgtcatttttctggcggtcaccataacatccatccagagaatgaaaaagaaataagaaggaaggggcatacatatgagtattttaataaagaatggaaccgtattgacagcggaaaacgaggtaaaagccgatgttttgatcattgatgagaaaatcgctgcggtcgggcagaatatagtgcaagatgttcatgaggtgatcgatgcagaggggaaatatgtatttccgggaggaatcgaccagcacactcatttttctgcgctttgtaattccggggataaggataccgcgggatacgagacaacgaaagcagttattgtaggggggactactacaatcatagattacgcgccccaggatccgggctgcgggctgattgaatccgcacagtaccgcatcaacacgagggcaaagggaaagacatgcgttgattttgctctgcattctctggtaaccgaagtgacggacgctatgtttgacgagataaaacagctgccggactatggcattgcaagtatcaaggtgtttatggcatatatcggttccccgctccatgtaggggacgataccttatataaggtgctccaggaaagtaaaaaggtgggggtaaccgtatttgtgcatgcggaaaatggagagatcattgatatgctgcagaaggagtgtgtaaaagccgggaatgtgacgcccgaattccatgcggtatcccgcccgccgcttgttgagacagaggctgctcagagagctatctacatagcggatcagttagacgccccgctctttatcgtacatgtctcctgtaagggggcgtcgggtgccattgcagaggcaaggtataaaaaacagagagtatatggcgagacctgtacacagtatcttacgacgacaaaggatcgcctgaaaaatccggactttaatattgccgcccaattcgtatgttcgccggcactccgtgatgagagtgatattgacgccatgtggcaggcattatatgatggtgtattaagcgccgtggtatcggatcactgcggaattgaccttgcagaaatgaagcagacgggaagggataattttgtggatataccaaacggggcgccgggggcggccgaccgcattcatatgatctggacaaatggcgtggctaaaaacaggatttccagacagaagtttgtggaggtatgttcggaaatgcctgcaaagattaatggcatatatccaagaaaaggtaccatagcagttggctcagatgcggatattgtaattttcaatccggactacagaggtgttgtacagcttgcggataacccgaatggcgtagactacaatatttatgaaggaagggagcagatcggacaggtagaaaccgtactgctgcgcggtaaaaaagtagttgaacatgcccaatttgtgggcgaaatgggacagggagagttcataccaagtaaaccatatgcttattgctttgaaggaagagaatagtcaggaggctgttttatggacaagatattagaaaaaatccgcgagtacggagtgatgcctcttgttacgctggatgatccgcaggatgcgtatgtacttggcagagcgctgacggattgcagcctgcccattgtagagattacgtttcggtccggcgcggcggaggaagcaatccgtattctcagaagcacctatccggatatgttagtcggagcaggaacggtgctggatgcggatacggcggagcgggcgatcaaagcgggggcacagttcgtactggcgcctggtatgaatcccggcatgatagaattttgtcttgcggagggaattcccgtatttccgggatgtatgactccgacagatctgggactggcgcagaacctggggctaaaggttgtgaagatatttccgttcatgcagatgggcgggatcccgatgctcaaagccatctcagctccctacggtaaaatggaatttttggcaaccggagggatcaatgacgagaatttggcctcgacccttgcatttccaagaatggctgcatgcggaggcagctggctgattaaaaaagaaaagcttagaaaaggcgacctggaaggcttgaaaagcgatattaaccggactttaacggcaatgctcgggctgcggtttgcacatcttgggatcaatcatgggatggaggcagcaaaaaaattggagcagattctgaatgtacagactctctgggggcaggcgtccggctttatcggagattatgttgaggctgtaaaaaccgcagggcaggggaaaaatgggcatatagcggttggaaccagtgatatcgggcgggcaatattctatctgcaaaggaaggggtttggtattcaagcggaatctgtcaaaaaaaatgaagcaggtcatatcttagctgcttacctgaaagtagatgcgggcggttttgcagtccatcttcttcaggaaacattaggctgagaaatctggaaagggttactatgtcaacagcaacggtacaatcaattgatagggcatttgaaattctggaggcgttgggaaactgcccgaatgggatgcaggtcaaagaactgtcagccgcgcttgcactgaataaaagcacggtgagccgtattcttttgactttggccagtaaaggctatgtggttaaaaataaagataattattatcggctgggaatgcgtctggtggatttgtgcagcttctatttaaacagtctccagcttaaaacggaggcgcttccgtttttagaagagcttagaaaccagacgggactcatcgtgcatctgggaagtttggatgaaaatgaagtagtttatttggataaaatcagttcatttaataatatacgtatgtattcccagatagggaaacgtgcctatgttcattgcacagggcttggaaaggcaatgctctcccggatgagccgggaagaagtggaggagatcctggccgcgaaaggacttccgatgatgacacaatatacctgtacggaccaaaaaaaattttttgctgaactggatcagacacgtgccaggggctatgccgtagatgagcaggaaaatgaggcgggaatcaggtgcgtggcggctcctgttttcgactacagaggcaatgtgatagccgctgtaagcgcaacgggatttattgatatgtttccaaaagaacggatagaagcaatgtctgtgtatgtgaagaaatgtgcggagagtatttcaagaagcatggggtatcgctgaaaatccgcgcgtgttattatttagataccccacttattccgaaaatcggatgagcacggaaagcaatacccaaagggcaccccgtaactcatgccctgcgggcgggtctgcagcaaagctgcagaataaggtatacccaaagggcaccccgtaatgcatgccctttgggtataggaatgggatatatttattaagggatactcccgggaagacaccgcccatttaagcgtctgtatttccgggagtagtctgaagaaaagcgaggtgagacatttggcggaagtgattacatttggtgaggcaatggttgtctttatttctgaggaaacaggggagtttaaagatgtttctgactttacaaaaggccttgccggtgcggaattgaacgttgcggttggaatcaccaggcttggacacaatgtaaaatacataaccaggctaggcacggatccatatggtgattatatttttgactttattaaaaaagaaggcattgatacaagcggggtaatatttgacaaggaccatttgacaggttcttatatcaagtcgaaagtccatcagggggatccgcaggttttttattatagaaagaattcggcggcatcctgtgtgagcaggaaggatatagatcaggtggactttgaaggcgcaggggtattacatctcagtggaattacggcggctatctctgaaagttgtctggatgcatgttattatgcgttggagaaagcaagacaatgcggaatgaaggtagtatttgatccgaatatcagacggaggctttggaacagcgaggaagaaatgatttcgactttgaatgaccttgcaggcaaatgtgatgttgtattacccgggatcgaggaaggcagagtgctggcgggcacaaaggatgaaaaagaaatcgccaggttttatttgtcactgggggccaaaacggtagttgttaagttagggtcatccggagcattttatcaggaatatactggaagaaacggttatgtgaaaggttttaaggtggacaatgttgtagatacagtcggtgcgggggatgcttttgcatccggctttatcagcggtattctggagggaatgccggttgaagatgcggttgtcagggggaatgcaatgggggctattattattacctccaagaccgataatgagatattgccgacaaaagaggaattagaaaagtatttgcaggaacacttgatgctgggatgaggaaaacaggatgaacgaattagacaaaattgacattcagcttctgaaagcactacaggagaatgcgcggacttcgatcaaggaactggccagtcaggtatacctttcttcgccggctacagcatcccggatatccagaatggagaagatggggtatatcaagggatacactgttatcgaaggagaaagcgaactggggtatccaatcaaagcaatcattaatattcaaacggatagaaaaggcagagaaagtctgttttcttttatctatagatgcccgaatgttacagaatgcgcttttgtttcgggaatatattccatagtgatatctgtcttttttgaaaacacacaaaaactggataagtttattaatgaaatccagaaacgtggggctgatacgatgacacagatcgtgctgtcaacacctatactgcacagaggcataggtggaattatggaggattaaaaaaaggggtctgacccctttttttaatctctgccgatgtgctctctgatctcggtgatcttcccttccttcatgaatattacccggttccccagcgtaacagcttcgtcgtaatcatttgtcacgtataatacggtaattccaagcactttattgatcttctgaatatcttcgatcatctccatccgccgctgttcattctgccttgcaaaatcttcatcaacaagaagaaccttggggtggcagacaacagcacgtccaagtgcaactttctgtctggcttcatctgagatcgacttaatctttttatcaagcttatctgcgatgccgagaaattcagcagccgtcttcacacgggtatcgatcactccgcgcggaagattccgaagccttaggccaagtgccatattatcataaacattaaaataggaatacagtacatagttctgaaaagccattgcgaggcttctgtccctgggaagtatgtcattgaggagatcatctcccaggtatatctctcctgaggtaatatcctccaggcctccaatcatgcggagaatggtggactttccgcagccgctggggccgtgaaaggcaacgaattctccatctttaatatggagagatacgttctttacggatataaatccgttaggatatgtcttatttaagttcttaaatgtcacgcttgccatagaaacacctccgcttattcttatcacaattttagcacataccgtatatcaatgcaaaggggggcaaggttttttaagggagtttttattaaaagttcagaatattcagaaaacggtgagcaaaggggtcagaaccctttacatcattcctgcgatcagtacgcttgcggcaagtccggctaaggttgccagcagagctccggtgagtgtatagcgcgtttttttaatttttgcggtcatgaaatatacgctcatcgtatagaaaattgtttctgtgcaggccatggatatggaggcgataagccccagccgggaatcggtgccatattctttgaagatgtccaggaggaggccggtggcagcggaggaggagaacatttttacaatggtgagtgggacgagttctccggggaagcctatgtatgcggtaaaatggccgatgattgacgacaggaaatcaaggaagccagaggcgcgcaggattccgactgcaaccatgaggccgatgagggtgggcatgatttttatgacggtgaagaaaccgctttttgcccctttaataaagttgtcgtatacattggttctcataagtatgccgtaagtaacgatagccagaataataaacggaactataaaatccgtaatatacagaaaaaactgcataaacatccctcggcaatctgtaatatcattgctttatttatatgcttatccggagaaaacgataccttattttgcagctgggctgcaaatccgcccgtcagggcgtgagcttacggggtatcattgggtatgaattaaaaggatggaatgtctggcgttagcataacaggggatttttactcataatatgaaacaaagactttgggggagttcctatgccatctctaattcccaaacatatcagaaaacggcttcttgccgcgtgtcttaccgtcagcacaacagcggcccttttgtttacagggtgcagcgtcagtacaaataccaaccagaataaaacattccagtcatttacaaaagaggtgttctgccaggaggtttcctcgaattcgatcagtctgcattattcactgaaggagccggaaaagtatggaatcaaggaagcaccggttacttttggcggttttactgcggattcgaaagaagcggcggcctcattggaaaatcttcgtgcggcacttgataggttttcttatgacagcctgtcggtggaaaatcaattgacctatgacgtcctggactattacctgaatatggcagaaaagaatacagattatctgctgtacgatgagcctctcggcctggtcagcggaatccagacgcagctgccggtgcttttatcggaataccagttctatgacgagaaagatgtggatacatatttaaaattgatgcagtcaacgccggaatattttgagtcacttattgcattcgaaaagcaaaaatcggcagcaggcctgtttatggcggattatgcagcggatacggtgatttcccagtgtacggcttttatggaaatgggtgaaagcaattatttgatttctaccttcgtggagcggatcaaacagcttggactatcgtctgagactcaaagccgctatattaagagaaatgcacagatgctccaaagttatgtcctgcctgcttataatcagctgatttcagccgtacagtctttaaaaggtactggaaaaaacgaggaggggctctgccaccttcccgacggaaagacctattatgaacagatcgtggctgaatcaacagggtcagaaaagactgttccagagctggaggatctgaccaggagacagattatatctgaccttgaggccatggaggaagtgctcaatataaccggaaaccaggcaaaagagacagcagccatggaggagagtaatccggttactatactgaatgaactggagcgcaaaacgggcggggcattcccagagccgcctgaaacggtgacacaggtcaaatacgtgccggaggctatggaagaacacctgagccccgcattttatatgattcccgccattgataatacggcggaaaatgtaatctatgtgaaccaatctcatatgagcaacaacctgacactctataccacacttgcacatgaagggtatccaggccatttgtatcagacagtatactatgccgggacagatcccgacccgttaagaagcatttttaattttggcggatacgtggaaggatgggcaacttatgcggaaatgtgcagctattacctgtcctcactgagtaaagagcaggctacactgctgcagaaaaacagctccattgtactcgggctctacgcacttgcggatatggggattcactacgacgggtggagcaggattgacacggtggcatttttcaaaaattatgggatcaaagacgcgaaaacaatagaacgtatttatgaacttattataggttcgccgggaaattatctaaagtattatatcggttatgtagaatttttggaactgaaaaaagaatgggccgcaaaaaaggggaatcatttttcacagaaagaattccacgaggcagtgctgtctgtaggaccggctccttttgctctcgtggaagaatatatgtggaaaatgcctgttgattagaggaacagccggaaaccacggtgattcattatctgaaaatcatggaagaatatgatagaacgcatactgattcttgccattttgctttgaaaggtacagcgcttcatccgcgtgcttaaacagctccctgaaagtgcatccgtcttccggggccagagcgatgcctatgctggctcctattagggggagttccctgtcagccgcagtgtttatcgcattgattgcttcaagaaactgtacaatacggtcccgggggacgtcgtcacttgaacagtcggggagaaaaattaaaaactcatcgcctccgatgcgcccaataatatccgaagagcggaacgtttcctgcagtacggcccctacttctttgagcacctgatcgccgcagtcatgcccacgggaatcattgaccagtttaaaattatcaatgtcgatgactaaaagtgcaccctgggcattggcgagggaaagatgggaagtaatctttctctcacagaatccgcggttccagagaccggtcagcttatccgtatctctttgcatttccagaatgttattagacatgatctgccggaaattgaggtagttgaactggtgtgaagtaaaaatgctgagcagataaaacacaacggtatttataatatcataagaggcagtgtaaggagtcttatatattttggataacatacaaaagatcacacagaatatgcccataaacatgcagatgcgggacggtatgtcaacgataaagaggggaagccccacaagaaatactataaaggctactgcgttgagctccggctgcataatggtacctaaatagactgagaccccgagtatgatggcagccatagtataaagggcagcaggtattagccttttatgcgccttcagggatgttttcgccaggatattcagaaaaacggaagctgcggtaataatagtatacggaaccgttgctttcaggaagttttccagaaaaaggctgaccaaaatgagcggaacgcccattaagaatcccagagttgttataagacgcaggcttttcagatttctgtctgcaatatcttcataataagtatgataattttcaacaaaatagttactatatggaatcataatgataacccccgattaaatatactgatacattgtttctattctatcatataaagtacgtaatattatgaataaaataaaaaattttaggagggaacctatgctgaattacttatgggcgggcatgattatagtcggtgttatcttcggggcttttaacgggaagatgccggatattacgaatgcggcgctggactctgcaaaagaggcagtaaccctgtgcatcacgatgatgggagtgatgtctttttgggtgggtatgatggagattgcaacaagggctgggattattgagattgcttctaagaagctgcggccgctggtacggtttttgtttccggatataccggaggggcataaggcgaatgattatattacgacaaattttattgcaaactttctgggactgggctgggcggctactcctgcaggactgcaggggatgggggcgctggcagatctggagagggagagacaggaagggcgggcgccgggtgcagcgcagaagccaggggtcgcctcggatgagatgtgtacgtttttgattatgaatatttcatcattgcagttgataccggtgaatgtgatcgcttaccggagccagtacgggagcgtgaatcccgcgggaattgtcggggcgggaattgtggccacggcggtgagtacggtggtggctatggtttattgtaagatgaaggcgaagaggcggagggcttgattgccctctgcttttgtaatcatatattttcataaaccacctgctattcagatatgtttacagccggcttataaagggcttactttgattagcccacctgtcacgacgaaacagatcacttgttacggagtagtaaccaattatgtatcgtcctcttataatagatgtggcacactcggtatgactactattttgctgtctgaattgattttcatgatcagggagcagtcattgttgtatattggcataagatgaataagcgaaataaaacatgtattatctgctaagcgggagaaccaaggataatctctacacctgcttctttaagtctggttacataagtgggatccaggccgctgtcagatatcaggcatgtgatctcgttgatatctattgttttttcgatgaacggttttacagaaaatttagttgaatcagccaggatatagcatttttttgcgcacttaatcaggctttgttctgttctgggatcaatatcgagagaggtaattcccacatcaagatccacagagtcacagccggaatatgctttgtccaccttcacagtgctaaaaaaggcttcggatgtaggaccaaaacacgcaccgttgcgttcgcggatctggccgccgcagacataaagctttatgttgggatggaacagaagaaggtttgctacagggatggagtccgtaacgacagtcaaatttttcttatttgtaattttagacgcaagaagaagagccgtagacccactgctgatggcaataaaatcgccgtcttcaatcgtttcagctgcggcggcagcaatctcctgcttcttattaaaattgacaatcccatcaaagatatccggctgaaccgttctcgtattaaaatcttttggataatccgccttgattgcgccaccgtgggtgcgcaatagtaatcctttttcatgcatactttggaactgaaggcgtattgtagaaacggacaagcctgtgagctcggctgcttcagcaacagttatcctgccattcttttgaagtaaatctaatatcactttttctcgttcttcgtaaaaagaaccgtgtgttttgcctgccatataattctccaaataataaaaggttaatctgtgaatgcattgtaactgttcatgattctgagcagttataatgtattttataattatatcattgggaatgttggaaaacaagtgaaaatgataattcactgtttttcatcagcgatattaattgataatcagttatattcaattaaagaacacagcataattaacaaatatcgatgatttaaattggtgataataacaaatacaattaaaaacaataaaaaacgcttgatattaattaaaaacggtgataatctaaagatagacacccggggaacagttaataaaatttagaaacagtgtgaataattcatattgagaaaggatgagtggctatggcgggaaataacaacagatattctaaagaatatctccaggaagcagagatacgacttgaggaaatggaagatcccaattatgaatttccaactccattcagtaaattagattggattctggcaattgcaacaattatagtatccggagcactgcttattggcggatattggatgtaatataaagggattttactgtatatgaggaggaataaaatggcaaagaatcgaaatagttcagatgatcaatatacaaaagaagcaacatttggcacactgccggttcgcagatcagaacgtcagtatggaatgttagatgcattcctcgtgctcagtgggtacggcgtagcaacctggtgttatacgcagggaacttttcaggcggcttactgtaattttaaacaattgttgacaactacctttgcagcaaacatttttgtacttgcgttatatttattgccggtactttttgcgacaaagtatggtatcgatatgtggcaatggcttaagtctacatttggcacaaaaggagccggagttgttgcgttagttctcactgcggttaattttccatggtttggacaatgtgcagagatatttgcaaacacaatagacaatttgattcgaatggcaggcatgacccctccggcattcttacataaaccaatgggtctgctttgcattgcattgggtacaattattgcaattgccggaccattggtaattaagtgggcaaaccgcattatcgttccattgcttcttctggttggtgttgctatttgtgttgtagcatttacttccgtaccacttggcgatattgttgcatataaaccggatctttcatttcttggtggtgacagcggtgcagcttatgcaatcgcgtgtgaggccggtcttgcatttgggatgtcctggtgtgcaagtactgcggttaccccgcgtttgtgtagaaaagaaagggacggttattgggctacaatcggagcatatggtgtggttgccccattttttgtaatggcaggcggggtactcggtattgcaacctttataaagactggcgttatggggaatgatattacagaaatgctggtaacactcagcagtcctatcatggctctcacaacattagcgctggttatatttgcgaatattgcaacgcaggggactggatcatatatgtggtctgtagttctcaaatccacattcccaaaggtaaagttcaatataattgctattgttctcggtgtttatgccggaattatggttatatggggacagctccttgattatatcggggcaatgattacaattgcggcattcttctatggaccagtcatggggattatgtttgttgactatttctttattcgtaaaagaaaagtttcgctgcgtgcggtctatgaactcgaaggacatgactgctacaaatacaccaaaggatttaatgtggtggcatttggatgcgctatcataggaattatcggcgaccttctgattttcgatccaattggatatgtgcccaaaagcccggtctttaattttgcaacatgtacattttttggatttatacttacagcggttttattctttattgcgaatcagattccggcaatcaagaagtatatgattcgtgaccgtgaagatataactgtataaagctttatatgaaaagaggaaatgataaaatgaaacctgaacttataattatgttaacatacaatgatgtaacagtatcgaatgcttccgaagtttttgaatcctgtaaggacttgcctataacccgctggggatttaaagatgttgggcttaagaaagaagagatgattgcgctgaatcgtgaaatgaaggctgccggcaagacaacatatttggaagtagttacatatacggaggaaggctgcttagaaggtgcgaagttagccggagaatgtggctttgactttttgaccgggacagtttattattcaagtgtagacagtttgctgcaaaaatatggattaaaatattttccttttgccggcaaagtcggcggaagtccggtggcattaacaggaacaattgaagagattgcagctgacgctgtcagactcattgaagctggtgctgacggtgtagaccttacggcatatcgttatgtggatggagatcctcttgaactggcacgcgcggtaggggaaaaaataggtatggataagcttgcaatagcaggcagcgtagggaacaaggagcgaatggctcagatggccaggctggggtgccattcctatacgatgggaagcgcattgtttgattctaagtttgtagaaaacggaacgttccgggaaaatctggaatacgttcttaattattgtaaccaataggcggatataagaataacgcagaaaggctgtaaaagtgagatatattcttggcatagatataggaacgactgcaattaaggcggcagtgataggtgaagatggaaaagtatatggcgaagagacatgtgaatatgtgctgacaacgatgccgtccggtgaggttgaggcagacttacaattatattcagaggcattttcaggtgcggtcaggggagcggtccgaaattcaaacgctgataaaaaggatataaaatgtatagggttctcttcaacagcggaaacatgtgtgttcctagatgaaaataataaaccgctttgcaaagtaattgcgtggatggatatgcggggaaccaaagaggcagaatatctgtcaaagcatttcagcaagaaagatattatcagtaaggtaggatttgataatatatatgcgatccatccaatcagtaaaatattggcagtgaaaaataaatctccggaagtattttccaacaccaggatgtttgcacagattaaagactattttgtttatgtactttcgggaagatttattacggaatattccgtagccagcgatcatggttttttcgatataacgaacagatgctattggcaggaaatgctggattttgtcggcattgacagaaagtatcttccggaacttgttgagccgggaacggaaatcggaaaaataacagaagaagcagcagaagcatttgggctggatccggatactgcgattaatgtaggggcatttgaccaagcctgcggggcaatcggagcaggaaatataaagccaggaatcgcctctgaaagcacaggatcggcgcttgtaactgttgcgaccattgaagaattaagccctgattcaaaaggtgatgtaccgacactctgcagtggcattgcggggaaatatatatatcagccatattgtacaggggctatgattacaaaatggtttagggatgcattttgtgagcaggaaaaagagctggaaaaggagacagggctcaatgcatatacgcagatggatcaattagtggaatcaacgcctccgggtgcggatggcctgattatgcttccatattttcaggggtctggtattccagaacttaatgaaaaggcaagcggtgtctactatggtataaatgcaggacatacaagagggcattttatcagggctattatggaagggcttgcaattgctttgaaaaggatgcttgaatgtgaaaaagagctcggggcggccatggatgaaatccgttcactcggcggcggctctaaatcaaaggcctggtgccagattaaggcggatatactcgggattccggttaaggtgattaaaaatagcggcagcactccatgtatggggtgcgcaatacttgccggagtagcaaatgggatatgggcatcagtagaagatgcggcggagaagtttgtggagattaaggagacttattatcctaatccagaaaacgcagaggtttatgcggaagcttatcaaaaatatgtggagattacaaatgcacttaatcctacattccgataacgcaggcgtgaatagtaatgaccgctcgttactttttataatccagccagtatcagtaaatcggaggttagtctcgtcgactaacctccgatttagttgttggttggagtgtgaaaagtaaggatcactcaattaaatataaggagaaattagataaattattgcagctatgataatattatgataaaattaagataaaataaaaggataaaggagcatcacatatgatacagatacgtcctgtttctgaccttcgaaataaatttccagagattgaggaaattgtaaacggaggaaaacctgtctatctaacgaaaaatggttatggcgcaatggtggtcatgagtttagagcagtatgcgaatctaaccgacaatatcgaaagaaaattggatgaagccgacaaaatggccgaatatacggatgaacgactttcacatgaaagcgtttttggacatgtcagggatgtgattaatggaaaataaaaagtataggctgcagtatctgccattatttgagcaggatttaattgagacagttcatcacattacgtatgtactgaaaaatccagatgctgccttgcgtttggcagatgatgtggaagccgctatattagagaggctttcaaatccacttgcatttgagccgtttcgttcggcgaaggaaagagaacttttatattatcggatttatattagaaactatgtagtcttttatgttgttatagatgatgttatggaagttcggcggctcatatacagaaagcgagatatagacaggcacttataaagatatagaacacaaaagttggtttaccatatataaactactttttatagttaccaatattccgataacttattaggatgttggtaagtagaaatgagaataattcctggtaatgtttcattaaggatcaaaatttgccgagggtacccgctaagacattaaaataacataggttagggtcatagattagatataattaatatgatcgcgaaagatgtaacaggggatgttataaaatctatttcaattaaaaaatagatattttataacatcccctgtttggagttttattgactttcctctatttattcttcaatccacactatttttcaatccacactattaaaatattttattatgtgaacttcaaataatgactataactattggccattataaaatacttaacattatattacaagcataaaattaaataaattcataaaaagaggtaagtattgaaattatatttataatgtgataccatcagttgtaagaaaagaaatcctggaggtatatcccatttgaaattattggcacatattactacatacaaaggcaagcggaaagagcagtctttaaaagaacacagctataagaccgccaagtacgcttcagaatgtctgtcaaacagaaagttttccaatactgcctatcttgcaggccttctgcacgacataggaaaggcaacccagctttacaatgagtatttggagaaagcattccagggagaaaaggtacagcgtggcagtgtaaaccatacttttgcaggtgttatttatctttttgaaaagttccatacagatgttaactcaccgatggaaaagctgacatgtgaaattaccgcaacggctataggttcccatcatgggctgtttgactgtgttgacctggatggtaacaatggttttatacatcggctgcggaaagacaggtcatcgctgtgctatgatgaggctgtcagtagttactttgaacaggtagctgatgaaagcgaagtgcagatgtatttccaaaaggctgtaaaagagattacggactttttcgaagaggcaagaataacatacaataataatggttataaaacattttttcaaataagtatgctgtccaggctgattctgtcttcagtgatagaaggggatcgaaggaatactgctgaattcatgagtcaatggaaggaggatgaaggggaagatataaactgggataagtggctggcctactgtgaagaccaactatcaaagctggatacgtcatctacgcttaaccgtatcaggcatgatatttcaggacagtgcattgctttcgcaggcaatcccccggatatctatcgtttgaatgtaccaaccggtggcggaaagacattaagtttgctgagatacgcactggcacatgcacaagaatttaataaaaaacggattatctatagcattccgctgctcagtgtgctggatcagaatgtccgggtaatacgtgattatgttccggataaagagaaggtattggaacaccattctaatgtagtgcatgaaaaagacaagggagaagagctggatccatatgagctgctgaaggaaagctggggtgccccggttatcgtatcaacactggttcagctgctggacattttgtttaagcaccagacctctgcaataagacggatgcaggcattatgtgacagcgtggttgtgatagatgaggttcagtcattgccggtgaaggtaacggaaatgtttaatacggcaatgaattttctgaagcagtattgtaatgcaacaattattttatcttctgcgacacagccctgctttgaagagctgaagtggccgatccatctggcaaaggagccagacatggttcatctggattcattacagcttcggacatttatccgggcacaggtgattgattgtacaagcccttacgggatggacttagatgagtgtacagaattttgcggcaatttggtaaaaaagcactcttcggttctgatcgtatgtaatacaaaatcacaggcacgaaaactgtttcggcgtctgcaaaaggaagccaaacagttaggcggctatatattacatctttccacatccatgtgccaggaacatcgttcaaatgacctgaaagaactgcaaaataaattatctctgctgcaggatgacgtaagaaatggaggcgggcagcagaaggtgatttgtgtttccacacaggtaatcgaagcaggaatggatatttcatttgaagcagtagtgcgtgttcttgcgggaattgataatctggtacaggttattggaagatgcaaccgaagcaatgagtacggaaatatcggaaaggtctatttgattcatcttaaaaatgagaacctgggtatgctgcaggatatcaaataccggcagatttgtacccggaaagtgttggaattaaggaagcagattggtgaaaccttctcaatcagcgggcaggcagtacatagatattatcaatacctgtttgaagagattcggggcaaagtacggtatccggtgaagtcttacggaacggagatttatctcatggatctattgtcaaataataatgggagtgctaacgggaaagaaaacgatggatatctgctgcatcagccatttaaaacggccggccagatttttgaagtatttgataaggataccatagacgtgctggtcccgtatcaacagggaaagaagctgattgagcagctcaaaagtatggaggaaaagcagttttatctggagaactttaaagaaattatgcaaaaggcaaaaaaatatacggtcagcatttttgagaatgagaaagaaaggcttgagagacaaggcgtactgcatggtatactggagaacagaatttttgttctggatgataaggcatatcataaaagctatggattgatggacatggaagaatacggggaataaaggaggaaaagatggagcacagaaattcagtagagtttgaagtgacgggaaagtacgggatgtttgcagatcccgtcacccgggtcggcggagaaaagtttagttatcaggttccgacctatgaagcgttgaaggggattttacatagtgtatactggaagccgactctgatttggatcattgacagtgtgcgcgtcatgaatcctattcagacagagacaaagggcatccgtcctataaaatattataataataaaaacgatctttcttattacacatacttaaaagagtgcagatatcaggtgaaggcacattttataatgaacgagaaccgaccggagctggaaaaggatcgcaatgagcacaagcatcataatattgccagacgcatgattgaaaggggcggcaggagggatatctttcttggagcgagagagtgccaggggtatgtaaaaccctgtgtgtttggccagggagagggattttatgacgatattcccgagatcaacttcggtacaatgtatcatgggatcacatatagtgacgaggcatattcggaagagacaagaggaaagatgtctgtacgtttttggcaggctgtcatgaataacggggtgattgcatttatacctccctggaaatgtatccacaggccggtgcgtgagatgaatatcaaaaagtttggcgtgaagcaggagaacttttctgtgatccaagaggaagaggtgatgtaacagatgtcctggatgagccagatttataaaacgtatgaagaaaatgtaggaaagggacagaatccggacgaacagatgactccggtggcgcatatgaacgcaaatgcacagattgaggttacactgagcaggcggggagagtttctgggcgcagcaaaggtagaaaaagaagatgcggttacgctgattcccgtcacagaagcatctgccggaagaagctcggggaagacgccccatgcattgtgtgatacgctttcctatgttgggggggattattgtcattattgtgaaaatgagaaggagaggaaaagcgccgaggccaagtataaactctatatggaagccctgaaaaagtggacggagtcaaaatacagccatcccaaagttgagacagtacaccaatatttgttaagaaaagagctgattcgggatttggtgaaagcgggagtagttgagctgaaagaggatggtacattccaaaataaaaaattaagcgggaagccttatgaaaaagcactggtcagattcagagtacagagcacagaaaaggaagctgacggcacatggcaggatgcatcactgattcaggcctatacggaatattattttgccaaccaggatgggaaaagggatatctgttattttctgggacaagaaagcgcaatttcccaaaaccaccccaagggaattgtggcggctaattatggtgcgaaacttataactgcaaatgataagcagggttatacttacaggggaaggtttcaagatgaagagcaggcccttgcatttagctatgaggcgtctcagaaaatacacagtgcgctgacatggcttgcaaagcaaaacggagcctatgcggggacgcaggacaagaggctttttatctgctggaatcctgaggggaaaaaggtaccgtccatatttggggatctgggacttacgggggatgattctgtggaggctgtggaaccgaactaccggaaaaagctgatcaagacatttcagggatacagaaatcagtttgatgaatcagattccgtagtgatcatgggactggatgcggccaccacggggcgcctttctgttacgtactattatcagttaatggcctccgattttttcgatagaattacatactggggagagacttgtaactggttgcttttgaagtttgacgggcaaaatcatccttattacggtatcgagacgcctacttttgaaagaattgtaaaatgtgcgtttggacgtgaaagggatagctcccatggaaagagcagattcattgaaataggtgataagctcctgaaggaacagatacagaggttggtgaaatgcatggtagaaaagcagcctgtcccgtacgatctggtacaggcgctggcggtacgtgcatccacgccgatggcttacacaagaggaaacagggaaagagtcttatcgacagcgtgtgcaataatcagaaaatactattacgagagagaaacggaaaagaaaggggaagaggagtatatgaagctgaatttagaaaaccatgacagaagttatctgtttggaagattattggctgtgctggagaaagtggagaggctgacctacgacagggatgaaaaacgtgagcccaatgcgatccgtctgcagtcggcttacgtcaatcatccaatgcagacgtggaagatattaacagatcagttgaatccatatcttcagaagctgcacccagaggcgagaaagaaatataaggatatgattaccgatattgttactgcccttgaggaaaaggatgaacagcaattgaacaggggattagaagaaacatatctgattggatattatctgcagcgggcagaattgaataagcgtgtagatataaagacaggaaaacaaaatacaaatgatcatgaggaggcaggagaaaatgagcatcttacagaataagattgattttacagtgttagttaaggtcatcaatgcaaacccaaatggtgatccgcttaatggaaaccgtccaaggacaacgtatagcggtcagggagaaatatccgatgtatgtataaaacggaaaatcagaaaccgtctgcaggatatgggagaaaatatttttgtacagtcagcagaacgcagtgatgatggttatacgtctctgagtgaaagggcttcccaaaatataaccaattaccagtcggatgatgactatgcagaacaggcatgtaaaaaatggatagatgtacgtacctttgggcaggtatttgcctttaaagcaaaagataaaaaagagggtgtttcagtaggggtgaggggtcctgtgtcaattcatcaggctttaagctgttcaccggtagatattaacagcatgcagattacaaaaagcgtcaatggggaaccatctgaaaaaagaggccccgacacaatggggacgaaacatctggttgaatttggactgtatagaattaaaggttctgtaaatgtccagctggcagaaaaaactgggttttcggaggaggatgccggaaagctgaaggagacgctttgtacactttttgtaaacgatgcatctgctgcaagacctgatggaagtatggaggttgtgagcgtatactggtggaaacataataacaagattggacagtattcggcagccaaagtgcacgactcattaaaaatatccttgaaagaaggagtagtgattccgtcttcggtcgaggattatgagattaggctggaggaattaccggcattggaagctgaggtgatttcgggaatgtgattaagtccacggcggtgagtacggtggtggctatggtttattgtaagatgaaggcgaagaggcggagggcttgattgctctctgcttttaaatttaattagtaaagatgactaaaaaagaacgattattattgtgaataatggacaaaatataaaattttgttgacaaatttaaatacaaagagttataatccacttataaatgaaacgtttcaattaaagcatagaggtaaagaatgtcagcaataaaaaaagaaaaaacaacaatcactcaggtagcaaaatatgcaggtgtgtcaattggaactgtttcaaattatctgaatggaactgctcaggtttccccacagaaagcggagaatatccaggccgcgatcgataaattacattataccccggatacggttgcaagctctttaaggaggaagaacagcaagacgatatatatcctgacgccaaatctgaataatacattttacacccggattatcagttcctatatggcatatgcgtaccaggcgggatatacggtacagatttccggttatgaatactctgccgaagtggaaaagaagcaattggctgctcttgaaaactgtaaacggggaaccattgtaatcatcttcaatggcagtaaagatgaggcggagatcaggaggcttatgcagaatgatatccatgtcatattagccgaccggaatgcagagggcttaaatgtatccagtgtatcatttgataaccaggatatgttatatacaattgtagaaatgttaaagaaaaagaattacaaaagaattggcttgtttatagaacctgttactttatcgaatttacagaaaagatatgaacattttttaaaggcttccgaaaaatttggctataaaaatcctttagataatgtatttacggataaaagtctggctcttaataaattacacagcagttatatttttatgaaaacaattctggaaaatcataagaaaaaagatttgccggatgcctggattgcctcatcggattacctggcgattggtatgatgcgggcaatgaatgaattgggataccgtgttccacatgattttgggatcataggttttgataatctggatatttcagggtatgtaaacccaaggcttacgactgtggagcagaatcaggaactgttcggcgaaatgctatggaaggtaacaaagaagctggttaaaacacaggagaatcaacatttggtaattccacaaaaattagttgaaagggaatcctgttaaaataatatgtattgcgtaagcggtacatttatttttataaaatattgaaacgtttcaatctgtacttcatcaggtatgtcagttattatttttttacacacattttgaaacgttttaatatagaaacccaaaaatattaaaggaggaacaggaaatgaaaaaaggtatcgcagcattattatgtgcaacaatggtattgggtctaacggcttgtggatctgatacaaaggaaacgtccggagagaaaaagacagaagaaacagcggcatcagaaagtgtgtcatccttggcgtcagacgaggccgtaaaaaaggcctcagaggaggggtgggagattgccgtagtgccgaaggattctacaaacccatggttcgtaagaatgaatacaggagtagaagaatttgcggatcagacaggtgtcaactgctaccagattgatacaggtgaaattgatgcaacgcatcaggctcagatggtcgaagatttgattgcccagggtgtagatgcaatttgtgtggttcctgtagatgtgcaatccatggatgtggtacttaaaaaagcccaggatgcaggaattgtagtaatcgcccatgaaggcgcagaactgaaaaatgtagactatgacatcgaggctttttcgaatgcagggtatggcgcttttattatgcagaatcttgcagaagcgatgggagaagaaggtgtgtataccactatggtggcatcgttgacaaacggctcacataatgagtgggcggatgctgcagttgaatatcagaaagaacactatcctaagatgactctgctggaagaaaatccgcgtgtggaatcaaatgataatggagacacagcatacaatgcagcaaaagaactgattaagacctatccggatctgaagggtattttaggtacttcttcctacgacgcaccgggtgtcgcaagagcaatccaggagctgggactgcaggataaattctttactacagggacaggcatgccggcagataatgcggagctgcttaaatcgggtattattaaatctctgacgttatgggatccggccatgtccggcgaagctatggtttcactggcttgtaaagtcctggcgggagagagtatcacaacaccattaaacctgaatgtagacggatatacagagatgtccgaacgagaaggttctaaaaccgtactggaaggccagggctggatcacaattgatgcagacaatgtagatagttttggtttctaataaactttgagaatcggagcgccgtttcggcggcggttcgattcttttaaaagcgaagaggaggacgcatatgtcagagtgtttgttaaaggcagagcatattcaaatatcatttggaagtgttcatgcactcaaagatgtttcattggaaatcgttcctggagaaattcattgtctggcaggtgaaaacggctgcgggaaatctacacttattaaaatcatctcgggtgtacaccagcgcagcggggggaccatcgaatttgatgggaaaaaactggaaaagattacaccaattgacgcaatcaatatggggattcaggttatttatcaggatttctctttattccctaatttgactgtagcagaaaacctggcattaaattcagaattagcatcaggcaaaaaaacaatcagttggaagaacgtaaggaaaatcgcggaagaagcaattaaaaaaatcaatatggatattgatttggatgaaaaagtaagccgtttatctgttgcccaaaaacaaatggtagcaatcagcagagcgcttatgttcaatgcaaaattgattataatggacgaaccaacgactgcattgactaaaaaagaagtagatgcactattcaaaatcatattaaaactgaaagaacaagggattgcaattctctttatcagccataaattaaatgaagtatttgaaatatcagaccggtttacaatctttagaaatggagagatggtggcaactggaagaacggatgaattagatgataagaaatttacctactatatgacaggacgtgaattcgcagacaaaacttttgttcctgaaaaggtgacagatacacctatttttgaactaaggaatctttctttggaaggttcatttaaaaatatcagccttactttacggggcggtgaaatcctggggattacaggtcttctggactcaggccgtacggaacttgcgctgtctatgtttgggctgaagcccgctacatcgggggagatcatccgaaatggaaaacctgtaaaaatcacaaatccgagagaggccattgccaacaaaataggatatgtaccagaagaccgtctgtcggaagggttgtttttacagagatccattggtgacaatattattatttctgagatcgattctttaaagaagaaaaatggccagtttgatctgaaaaaaagagatgaagaagtagaccgatgggtaaaagaattcgagataaaaacaaagaatccggataatcccgcaaccaccttatcaggcggaaaccagcagcgcatagttttggcaaaatggctggcatgtaatccggatgttctgatcttaaatggcccgacagtcggtgtcgatattggatcgaaacatgatattcatgcaatccttcagcgattagcccaaaaaggcctgggtgttattattatttctgatgatctcccggaagtaatacagaactgttcacgccttttagtcatcaaagaaggttctatagttgccgaatatgatactcagcaggtaaaagaacagatgattattgatgcaatgatgtaaggagacaggcgaatgaataaaaaattaaaatcaacatttaaatccaatgaaatatacatatttttcattataattgcgttaggaatcttggtgcagattcgctcgggacagttttttaccggaaataatatggtggatttgttaagtgcgatgattgtacccggaatgtttgcggtggcggaattcttagcgatcattgccggaggcattgatgtatcttttccggcattggcttctctgtctgcatatgcatccaccaggattttgctggaccagaattatggcggcaatgtggttctggcttttgtgattgccatggcgattggcgcgctgttaggcgctgtaaatggttttctgattggttatctgaatctcaatgctatgatcgttacattaggtacttccagcgtatttcagggattcatgcagggagcactgcgggcaaaacagttatctgttataccagctggtatgaaagaatttgggacaaattcgtttatcacagcaacaaacaaaacgaataacctgacttccatcctgccctacacttttattattttgttgattgtttgtgcagcgatgttccttatcctgcggtatacgatttttggacgtggtatctatgcgatcggagggaatccggtcagcgcacatacggtaggattcaatgtaaaacgaacaaaatttttcatgtatattatcattggcatgattgcagcagcaggcggtatctgccgtgtatgtatgatgcagcagatgcacccgaccaacatgcttggaatggaaatgaatattattgcaggtgttgtgcttggcggagttgcgctgactggcggggccggaaccctgatcggatgcatactgggtacatttttgattatactggttcagaactccatgattctcctgggcgtgccgactacatggagtaacgtgtttgttggaatcgtaattgttgtgggcgtggcattaagtgcataccagtctatcaggactgaaaaagcaaaaagtaagatggtaaaggaggcagcataatggagagagtaaaatgtttttattcaaaaaaccgggaagtgagccgtctttttattattatgattgcctggctgatctttatgctgctgacacaggccggtaagttttttacaggtgcaaatttcctgactatggcaggacagttcccggagtatggcctgatggcattaggaggcatgctctgcatgatgaccggaggaattgatttatcagtagttggaacagccaatatgacaacgattatcagtgtctacgtgctgaactggatttttggtgtagacggaacgatgccggcaggcttctctgttgtgatatttctgattgccatacttaccggctgtgtgataggggcttttaatggttttctgatttcggaattaaaggtgccgcctattttggccaccttaggagtaaatcagctgattaccggtttgtgtattgttattacagggggggcggctgtatcttccttcccaaaacaattttgcgatattttttcaacgaatttgtttggcattattccggttcgtgtaattgtcttcatactggcggctgttatgatctggtttatgctggagagaagtacctatgggacgaaattgaggttatatggatcaagcgcgcatgtagcggagttttccggaataaacacaaagaaattagtttttaaaacctatatggcttcggctgtttgtgcctctgtaggcggtctgatgatgcttagtacatacgcatctgcaagagcagattatgggagtaattataccatgcagtcaattctgctgattgtgttgggcggtgtcagcccgaatggcgggaaaggcagattatctggtgtggctgcggcaatcattcttttaaaatttatagaatcaggtattaaccgtttcagaagcgtttccacatactatgtaacactgatttggggcgcggttttaatcctggctcttgtaatagattattttagcgcacgtcctaaaaaagtaaaatagtatgggagaataactatgagcagaaaagtttttgggcagattggccggcttaaaaaagataaaatccaggagtatagaaagctgcatatggatgatgtacatacaccgcattgggaaggggtgctgcgcatgattcatgactgcaatatacggaactacagaatctttatgaaagatgatttagtttttggatattttgaatatgttggagacgactatgaggcagatatggcaaagatggaagctgatgaagtaaccaggcagtggtggaaacttacgcgcccctgttttacagaatattcagcttccagtaaggaagcattttatgaggacatggatcagatctttgattttgcagaatagaaagtagaggcgattataatgaaaacaattaaagacaaacagattcttgttggagcagattttgcaggatttccattaaaggaggcagttgtagctcatttgaaggaatatggatggaccgtaacagatgtaggggttcagtctgaggatgacagtaacacagaattaatgtttcacagaattggacttcgtgttggttccatgatatcggaaagagaatttgaacgcgcattaattttttgcggaactgggatggggatccatattgcggctagcaagtgtccgggggtattttccggcgtggtggaaagtgtaccggcggcacttcgtgcgattacagggaacggagtaaatgtactggcaatgggagccttttatgtagcacctaagatgggatgtgatattgcagatgcgtatctgagtaataatctgggtgatgggtatgagtggtggcccaatttttatgaatttcataaacttgcgtgtgatgaactgaacagctttgattataacagatataaagaaagcgggtataaacttgaacatttgggagattatcctttagagctgatgcaggatccgaggcttttcggctgcaggtagaaatgagaaaaattatatactttagaacaatagaaaaggtttgatatgctcccttccgggcagcaagttgaagtaataaggacttgcgcttgggagggagcatattttatgggaagaaatagcaggggagcggcagagagtataaaaatacacccctaaagtataaaaaacgactcttataaggcaactggaatccgtatataatagattcaggatatccgaagaagaaactcatttagcagtgaaaaagtgaaaagtacgtgggagggttcatcatgaaaagaagattaaaaaaattggccgcttttggtttggcagcagttatgacaactggtttgctggcaggctgcggcaacggacaggccggcagtgagaaaacagattccaaggaagcggataagtcagcaaaaaaagagactacgctggaggtcgaggttatctatacgggtcagccgttggatcagttccgggaagttctggatggattcacagaagagacaggaattggaattgaattggttacaccgggttcagattatgaggctgttatgaaaacaaggatggcatccggagaaatgccggatgtttttgtgacacacggctggtctattgcaaggtataaggaatacctgacagccttgaatgacgaagagtggtacgacagaattgatgatccggttctgccgattatttctgacgaagacggcagcatatacgtactgcctgtcagccaggtgacaaacggtgttgtatataataagacagtgcttgagaatgcgggagtaaatgtcggcgatatccgcactatggacgattttaaagatgcctgtgagaagattaaagcttccggcgttaccccattttttgtgggaggaaaagacacctggactgcagcggttctctataatgcgatggcgccggcattttataccacagaaggctgtaaatacccatcaggtgaggaactgaaagatggaaccttcgactgggatacaaaaggaagctgtgttttggaagaaatcgcagatatggtacaggctggttactttaacaaagaccttgttacggctgataatgcggcaacccttacagctttgggtgaagatgcctgtggatttagtaccgaggttgagattgtgaaagtgttaaacgtagctccggatgcacagcttgggattatgccgattccgtgtacgactgaggagggcaaatcccagtatatgattggggaaggaagctgctttggaatctggaaagatacagaaaagatggatgaagcaaaacagtttttaaattaccttgcaaaaccggaagtggcagacaagatcatggaattggacgggggactgcctgctcttaaggatatgaatacggaaaatgtaagctacaaggcattttcagaaagccaggaaatctttgaaggtgatatcttctacgataatctgtttgaccgggaatatttcccaagcggaatgtttaatgcagatgccgatgcagtgatcgaggtatttatggacccaactgaaaaagggattaacgccggactgcagcatttaaagagcacgttccaggataaatatgtagcagcagagtaagcgatgtaaaggagtgaaaccaaagtgaggaaacgagcagtaaaaatgagctgcttttacattccggccatttgtctgattttgttttttgtggtgaggcccttttgtgaaacggtttatgtatctttgtgtaagtggaatgggtattcgccggaaaaaatcttcataggacttgaaaactacaaggaaatgttttcggacaagcgtctcctgacggcatttatcaatacactcatatacggttttgtgtccactgtgcttcagaatatcatcggattgggggcggcattgtttgtcaattcccgttttaagggcaataacctgatccgtgtggtgatctatatgccgattatgatatcaagcctgattatggggtacatcatgtatttctttttaacctatgacaatggtgtgctcaacgacattctgggggtatttggcaagggggcagtggattggctggcagacggaaggaatggagttctgtttattaccataattaacacctggcagtacgcgggatattgtatgattatatacctttccgggcttcagaatatctcgaaaacatatattgaggcggcagaaattgatggagcaggctcatttgcacgtttccggtacattaccctgcccatgctgattccggccatcacaagtgctgtgatgatcgacctgatcggcggactgaaaatatttgacggcattatatcattaacaaacggcgggccgaattacagcacacattcgatgatgacgtatttgaacagccagtattttctggcggagaaagcgggttatgcatctgccataggtattaccacttttgttatgattatggtggtcgctctgtacagcaatcactatttagagaaaaagagtatagaagcgtaaagaaagcgggacggttaacagatgaaaacaggaacattaaaaaaacagatcaaacagaattggtggaagtatctagtggcggccggcattttgattatttatctgcttccgatttatgttgtagtagttacatccttaaaacctatgacagatcacacgtccaggctgctgccgcccatggaacttcattgggagaattatatcagggcatttcaaaacagcaacatattgaatgccattaaaaattcctttattattacagttggaacagttatgattgtagtgattgtgggctgccttgcagcttatcccatggcgaggaatagaaaccgtctcagtaagaccatgaagacttttgtgctgggcgtgatgatggtgccgggaatgtctatggttgtaggtatttattccaccctggtctcgattcacgcgatttctacctactggggaattatcgcggtaagtgcggcgtttggactgccggtgtccatttatatgtacagtaactttattatggcaatcccgacgtctctggacgaagcagcctatatggatggcgccggaattttaaggacattttttcagatcatccttccgcagctgaagccggtgacggccacggttgtgctgatgcaggcggtttcaacctggaatgaatatggatattccctctatattctgcagaagaaggaaatgtataatgtcactctgaccgtaaagcagtttttcggggagcagatgaaggacttaaacggtgcagctgcctgtgcggtgattgcgattgttccggtggtgattgcctatttatttttacagaaatattttatccagggcagcctggacagtgcggtaaaagggtagggaagaggaaagtgttcctatccatgagccgtcacaatgagacacgatacaaggagtaaataagatgaaaaaaattgcatttataggcgcaggcagcgttgtatttaccagaagcttagtgcgggatctgatgacgtttccggcatttcaggatgccacgatagccctgatggatattgatgacgaaaaactgatgtatgcagcaaaatctgtggaaaaaataattggatcagggaactatccagctaaagtaatttctaccaaaagtcggattgaggctcttaaggatgccgacggcgttgtcagtaccatcaatataggagaccttgatgtctgggcaaatgatattacgattcccaagaaatacggtgtagacatcaatgtgggggatacgaggggaccggccggaatcttccgggcgatgcggaccctgccggagatgcttgctatctgtaaggatattgaaacctactgtcccggggccatatttttgaactataccaatccaatggcaatgctgtgcagagggatgcaaggcgaaacaaaggtaaatgtgacgggactctgccacagtgtacagggaacggcagaaatgctggcgaagtggatcggagccgatatggaggatattacatatacttgtgccggcatcaaccatcaggccttttatctggattataaatggaagggggaggatgcataccctctgattaaacaggcggcagaagagcattatcaggaggagatcgtgcgaaatgagatgctccgccatcttggctattatgtgacagagtccagcggacatgcctcagagtatgtggcctggttccgcaaacgtccggatcttattgaaaaatactgtactcacggaacaggctggaaccccggacactatttcatggtgaaggacgagtacgaaaaaagagaacatacctggaagaaagaatttttggaatgggccgacaatccggtcaatctgaaacgtggaaatgagtatgccgcgaatattttcaatgccatgtttggtgatggcatgctgtataaattcaacgggaatgtaagaaacttcgggctgattgacaaccttccggaaggctgctgtgtggaagtgccggtacttgcctccaaaggtacgctggagccgattcatgtaggtccgctgccttctcatctcgcgcttttaaataatgtgagcgccagaatcgaagagctggctgtagaaggggcaattaccggagatccgcagaagatctaccaggcctgctattttgacccattgacgtccgcagtcttaagccttgcagagattaagtctatggtgagggaaatgtttgaagcaaataaagaatatctgccgcaattcaaatactacgaataaatatagaggagattatagaatgacatttcgtgagaacgtactggcaatcctgcattatgaaacatttgaacacttcccggtagtttcctttggatattgggaagaaaccttggacaaatgggcgcaggaaggccacattacccgggaagaggcagaaggataccgcagggaaggggacaattcccccgctgataagtctgtcatgaagcggttgggattcgattttatctggaattcctgtctaagcgcaaaaaatcagatgttcccagcctttgaaaaaaagattctggaagaaaaaccagatggcagcaggattgtaagggatgagcagggactgattgttctggaaaaaccggacaccatttcaattccggcggaaattggaacctcccttatggaccggggggcatgggaagaactttatctgccaaaacttcagtggaaggaaacacgggtggaccgggaatttttcagaaatatttcttctcaggacagtagggaaatccccatcggcctgcactgcggctctctgattgggtatatgagaaatctgctgggggttgagcagttaagctatctgtatgtggatgatgaggacctgtatgtggagatcattgacactatcgcagaactggggtatcaatgcctggaagaggtcttaaagacaggagcggaatttgattatgctcatttctgggaggatatttgttataagaatggcccgttggttacaccaaccgtctttgaggattatgtggctcctcattataaaaagtatacggcattgctgaagcagcatgatattgacatcgtttctgtggactgtgatgggtgtattgaccggctggtacctatctggcttgagaacggggttaataccatgtttcccattgaggtgggtacctggaatgcaagtattgggccatggagagcacagtatggcaaagagctccgcggcgtgggcggcatgaacaagacggtatttgcccgtgataataaggcggtcgacgaggagatagagaggttaaagccgctgattgaactgggaggatatatcccatgtccggaccatagaattgcgccggatgctaagttcgaggtggttcaatactactgtgagaaaatgcagaatttgaaattataaagaatggggcgcaatggggtctgacccctttgcgtaccattttctgaatattctgaacattttcagggagggcataatgaaaaaatattctttgaaggtatctttgtaccgggcatttgccagttctgtgcttatgcccttcattgtaatcagttttattttattgaacttttttaaccatcaactcttaaacagctacaatacaaacaataggattattcttcagactcttacaaatcagctggacagttccctgcagaatggagagcatttttttctgcagtatttggctgacacgaatattgccaggttttatcaatatgttaataacaatagaattgatgcgtcgcaggagaatttgtatggttatatccgatattcggtcaagtacagaagcgcattgaataagtatctgaccgtgtcggacccgattcacagaggcattggatttttgccggaaaatgcgaataagggaaatttcttttatttgaataagtatggaggatcaatcctgcggtatgaggagaatgcagagccgttgtatgaagagctgacaaagctgttatctggcgaggtgagatttttccccggcagccttatgtccaaaagtgaggaatatcaagaagagcagcctgtctttaccatgctgtgtccggtgagcaatctggaaacggcatcccggcagggatatgcgtttttggaactgtctcaatcagtattttcagacctgaatgaaaaaattacgctgcctgagggcgctggactggttatttattttccagacgggactccggcctatgccacagaggaaaggtttatcacagagcaggatgatatggaggacacgaaagaactcatgggcaggaaggtgaagatagaaggagatatacattatctgtaccatatgaaggaggagaaatatgggttccaaattgattatgtgctgcctcacagcaccatattaagggaggctaaccatacctcatttgtgatcctgctgttttggttttgtgctatggcagcggcattttttatttttatgaatttaagccgccgtatatctgtctccacggaaaggattgtctcgtatatccagaagtaccggttgggagatgaggagagcagcgggaatatgcctgcaatccctatagaggagttttcggagatttctctggcaatgacggaaatgacagagcggatcacggatcttgtacagcacgagtatatctggaaaatgaatcagcagatggcggaatataaggctatgcaggcggaaattaatcctcatttcttctataatgtaatgaactcccttcaggcgttgaaccggatcggagatacaaaaaatctggaaaaggggattttaaatctttcccggatgtttcggtatacctgtgaaccgggatatgattctacggttcagaaggagtgccggtttatcgagagctatcttatgctcgaaaagatccggtttgaagagcgtctgtattatgacattcaagtggaagaacagcttcaggacttctctattcctaaacttttacttcagccactgattgaaaacgccatgcggcatggtatggcacaggatggcagctctttaagtattgtgctgcaggtctgccaggtagagagtaaaaatgggatggcttttgtatggattcaggtagcgaatgacggcattccatataatgaacaggacatctgtaccagggagcgggtgggaattacaagtgtgcgggaccgcctttgtattacgtatccggactcttttttctggtatgatagaaaaggaaggtttcagacggtctgtaacctgttgattgcaaaagaagaataactgttacaaaaatctattataggggggaaggcagaggtgagttatgaagatcttaataacagatgatgagaggctgataaggcttagtttattgtctatgctggaggaattgtatccgggggtgcatcacatttcacaggcaaaagacggggaagaaatgatccgtatggtggaaaaggaattttatgatattgtatttctggatattaatatgcccaaaatcaatgggctggacgccctggaggtatgccgcaaaaagtcgccggagactcagtggtgcgttctgaccggatatgcggaatttgaatatgcgaaacggtcgatcggccttggagtcaaggaatatctgctgaaacctttggatattgatcaactgaaacagcttatggaaggtcttatgaaagaaaagcaggaaaagcttcagaaccagaatcagctgtttgaaaacagggtaagccgggcttttgccctggcagatatggcaggtgggattaagcagatgcagcctgcgggaaaggacagcgtttacagcatatatatattcttcctggatacggatgaaaataaaaagaggcaggaaatgtatgcaaagctgtatgaaaacctttcggactatttgaaaaaaaatatagagtgcggggaccgctatgctttgtttttcctgcagaccagtgaactatgtctgatcatagaaggaagagaatatatgaagctgcattcttatctgcgccaccatcgggatgtatttgacacagatgcgagaatcgcagctgtgtgggcggcggcaaaggattttaaggagctgtatatggataaacaggttatgctggcgctttcaaacgtgcgtatacttgaggaaaactataagacgataaccttgcaagagttaaatgagcagagcaatttgatggaaaagcagtacttatgtgaaaaaatagaaatgcttacggctagttatatgacaggaaattacgcaatggcaaacgaattgctgcaggaaatggagcgggaggatggtctgaaagacagttttcaaaaaatagacagccgcccactgcgctcctatttatccgtggtctggaaaagcagttttgagggggaagaatatgcagatctgctccggcaattccaaaatcttctgcaaaatgctatgtgggatcataacagcgaaaatcaggatattgtacagcagattaaggagtatgtggcggctaattatatgaatgacgtgaccatagcggagatggggaaccgttttgatattagtccgtcttatatcagcaggatattccggaacaaaacgggggagaaatatattgattttgttacgggggtaaggatgaagaaggctatggagcttatccggatgagccctgctttatcggttaaggaagtagccgaacgtgtgggatatatcagtgagaagcatttttccaagacctttaaaaaatattttgactgtctgccctcgcatgcggcaaaagaataaacagtctcttaaggaatacaaaagatgttgcagagtgaaaaacaaagttgcagaatgaaagcatatgtgctatactaaaaacaacaaacagaacaaacgttccgaggaggcagttttatggcaaagacagaatttcatgaacggctggcggggtaccgggcggaaaggggcctcacacagacacagatggcggaaaagttgggaatttccagatcaacctatgcaaactacgaagtgggaaagcgtaccccggatttgtggatgctgatcaaaattgcagatgtgtttacctgttcactggatgaactagtggggcgggatactgcgatatcgaatacagaaaccgtctgtccgacggtagttcgcgaaacggcatctagttatggtccgtcaatagggcgtgaaccaatgtccggtaatccgtccacgatgagggaatacatgtccggctattatgcagaactgcagacagaaaagctgaatcgtccgaattccctagaaaggcgcaggtgccgcagagagaaaaaggggctgggaaaaggactggcaattggcgagcaggactttcgcaaactgcgtgagctggggggctactatgtagacaagaccatgctggtggaacagtttttggattcttacgagaatgtggttttgattacccgtccgagacggtttggaaagacactgaacatgtctatgatggcggaatttctggactgtacgaaggacgcggaaaagatttttgaaggaacagcgattgcgcagacggagacctgggaagaccggaatcaatatcctgtggtgtatttatcctttttgaatgtgaaaggggatgtggaaaaaggattttggggatggctggtaaatgtactgctggcagaatatgaaagataccggtttgcttgggaaagcgggcaagtgtccgaagcgtgccggaaaagcgtggaacaactgctggaggttctgtgggaaattaagagcggcgagatacagaaaaagtatgatatcaccggagcgatccaactgctttgccaggtattggaagagtactttgaacagaaggtattcctgcttattgatgagtacgacactccgtttattgctgcaaatgtgggtggttattttgaggagataagaggggttctggctcaattattgtcatctgcactgaagggaaatccgtatcttgacaaagcatttttgacaggaatccagcgtgtggcaaaggaaaatattttttccgggctgaataacctgctggtcagtacagttaatgatgcagagtatgcccaatattttggatttacagaggaagagacggcggagcttttgaattactatcatctggaattgacagaagaggtcaggcagatgtacgatggctaccacattggcgatgtagatttgtataatccctggtcgatctgtatgtatgcacttcggaagcgcctggatcccttttgggtaaacaccagtgaaaacagtatgatctgcaatgccatggatcactgcggagaggactttcgggaagactatgagcagctgattgagatgggaactgtgacgacgaaggtggaactggaaagttcattttacgaagaggcaagtacagcatcactttggggattgttaattaatgccgggatggtgacagtgaaagaaaaaacagatagagggatgtgtaaaattcgaattccaaatcatgaggttgggagggcatttgaagatttgacagcacatcatttaggtgtatcggggagcaaactgtcacaactgggggatacgctttgtctggaaaagctggacgtatttgcagatgtataccgacgtatcttgcttgagctgccgtcctatcatgatttgaaggacgagaacagctatcatatgatggtgctgggaatgtgttcctgtctgtatggcgagtatgagatcaagagcaaccgggagagcggtaagggaagaagcgacctgattctgaaaaatatgaccggaaagtatgcccattacatactggaatttaaatacacaaaagaagagtcacagaatctgaccgggcttgcggaagaagcgatccggcaggtgaaagagaaaaggtatgatgcggggatgaaggggaagatcttctacatcgggctggcacaccggggaaaagaagcggaagtggtttgggaagaagtgtagaaggccgcaggaagatccactagggacagaaggtaaagagaggacaggtgaacacagatagactgcaggagtttgatttgtggcaaaaggacatgggtatggtgttaaggaagagatcaaattttatatttccctgcatgacttagatgaagagcggaaaatataaaaagtaatgcctggataaaccaaagataccggtggatttaaatgaaatccagcaggaacagcagacgtggcggaatattatcaggtatgggcgaaagcacgggaagagggacaaggcagctttagatgctgccttgtctttttgtaggattggaaacaatagttgaagatataaatggttaagctttaaacatatgcaggcacaatttaaaatgaaggatattcacttatcgaatgcgaataggaatggaatcatctaatttatctccgaaatcattctaaactccgtaggagacataccggctatttttttaaatgtattagaaaaatagctaacatcgttaaaaccaacggccatggcaacatcccgtaatcttaaggaatcatcctttaaaagtttcttcgccttttcgatccgtaacaaagttagatgttcagtgacagattctcccgtttcttttttgaataaacggctaagataactggcattcagaccaacagcgtctgcaatatcggtaagcccaatctgctcattatagttgttttcaataaattgtaccgccttttttatggggagattctggctgtgtgagggggaagatgtattattttcatcgctgtaaaacaggattttcttatcacttttcgcattatgtttgaaacaataacagcattcaaggtaagctgtattcagctccgtgatagaagaatgcggtgtactgatcgcagcttttaatctgtattcagggtaactttctgcaaaagtaaaaatctgatttaaggagggcacgatgggtgtatgcgcgagtttccttgtgtcatttaaaacaatacacaagtatcttgaatgtaccggaaaaataaccggttttacagaggcgaaaattcctctgagaaatcgagcaattgtgttgataaaatcttctttaagctgggcggagtcgccaataatgcgaatctttatgagaatacagtaaaaatcagtgccggatacctgataaagccgtgatttttcaataatttcatccggtgaaagcggaacatcgtagacaagatcctggtagaattttatctgaagctcttcctgatttttgataattgtctcctgaatactgtcaaactgacgctgctttttttgctcctcctgtatggcactgattgccctgcggacagcattttctatcttacttaaggggttgtcctttaatataaagtcgaatgccccatgacgcagagcctcctgggcatacttaaaatctgaatatccggacaggatgattaatttggtggaaggggcatatttccggacatactctgctaactctaagccgttttttcccggcatccggatatccgtaattataatatccacacaggctgtctggagaaattcgacagcttccagcccgtcggatgctgagtgggcaatctgacaatccagaccctcccagtctataaaagtgctgatcccttcccggataattaattcatcatctacaatcatgattcgatacatagaacatcctcctttaagctctgtcatgacagcggcagtttgacagatattgtagttcccgcgcccggggtgctgtcaatggttattccatattgttctccataggtgtattttaagcgtaagtgtgtattgatcagaccgatgtggtgtccttttccctcggatttagataacgcagaagcatctggttcgttcagccgtctaattagctcttctgggtgaaaaccaataccattatcaatgatttggagcagcatttcctgatcatctgtgatatctcctgtaatcaatattgtgccttcctcaaccttattctccaaaccatggacaactgcattttcaacaagtggctgaaggcaaagcttcaggatgaaatggtccatcaattttgtatctacatcaatatcgtaagatagttttggaccaaagcgcaccttctgtatctgcagatagtaccggacattctgaagctcttcctgcaaagtaataaactttgttgcgggtgtataaatattggcatttagtaagctgctgagtgccgtaatcatctcgtaacattccatatcctggtttgcccgggctttccagctgattgacagcagtgtattaaacagaaaatgcgggttaatctgcgcctgaagtgctttcagttcactttcttttaagaggacttcattggcatacttttcatttaaaagcttcttgatctgagaggacatcgtggtaaaagccgtacttaggttatcaagttctgtaatcccgtatactggcagggtctgtgaatagtcgctttgacttaaccgcgtcatccgtttaatcagtaagttaatatatctgcttacataccgggaaactgcaagggcaaatacgataacaagcagcagcaggcagataaagataaccagatatcctcttaattgactatgaagctcctgatagatgggatccagaggaatcagtacgcaggcagtaagcggataattcgttaaagttttcgttttggccagatagttccccgaatcttccatcatctgtttcaaagagaccccatgaacggttaaattggatatggttttgccctggagctcttttttgctgctcatgatgacagtacctgattcatcaaaggcaaaacaaagcgtgtccgtgtacttatcaaagtcgttgaaattggacatgagtgattcctcgcttaattggaaactgagcaggcctctaaaagcgccgtcgggatacccataatagtcacgtatataaaacaagcttccggagtcatcccgggaatgcagcagggtatggattctttcggcacccagtgatttactgagtgcttcccaattttcggtaatcatgtttagagaggaagagtcctcctgaccgggatgaacgccatatttcgggttacctatataatgatacgtattaaaatcattcgtaagggtaattgaagtcaggatattttcgttccaaatcgtagagtaaaacatcattttcgtaaggcgctcatcgacagattcattgaatgtggtttcattgcctggaaagatataattgtaaagctcggggttaattaccggatcgctgatgatggagtaatatgtattctttacagagagcaaagtagagtcaagagagctgaaggagctttctgcagaggagccgatatttctctcaattgtgtcaaaggtgctattcctcagagttgcatagaagtaaacacctgcaatcatacagggagtaatcatacataaggaaataataagggttattataacaaaaagcgatacaggtttttttgaatgcagcagcaaattggacacccccataaaaagtaaaaatattacataatataaaaatgttttacatgtttccagatcaaaagcattataatgtaaaaaatatataaaaacaagtaaaatccactgatttatttatagattatgctgagatataatgaactcatcaaaaatcagaaaacaaaaaggagaaaaggaatatgaaagtaaaacgaatcatatcgttaatgctagcatttagtatggtggcaggattaacggcttgcggtggggaagcaggaggaaaagcaaaaaaggaagaaggaaaggtaagtattacagtttttagtgaatgggtaggggcacatccgtatgcaaagtatttcgcagagagggtggaaagcttcgaggaagcccatccggagattgatgtaaatgttgaagagattgcaggttctactacggccaatatggatgccaaattaaaagtacaggtttcatcaggagaactcccggatgtattctatactaatgaccagagcattatcgatctggccaaaaagtcaaacttactttatgactttaaggaaaaactggatgcagatgccgaattgaaggatgagctggatatggaggacattgcatcatggaatgaggggtcggatcaggtatatggcatctgctcccataaagactttttcgggtttttctataataaggaaattctaaaggcagctggttatgaaaaatttccagagagctgggatgagctttataaattatgtgaaaaattaaaagaagatggaatagctgctatgtctctggaaacaaagacagcatggtattcaagccttacacttctggcagcactggccagtggaagcgaagaagggcaggagatggcgaagacggttgggcttactgattacaacactccggaattcatagaagcggcgtcacagctccaaaaaatgtttatggaatattcaacaacagatgctccgggctcggatattagcgttgctttaaataactttacaagcgataaaacagcgattgttttggatggggcttggaggattgctgaactaacggaagctatgggagataaggtaggagaagcatatcttccgggcaaaggggctgtatcttacccagggtatgcatggttctccggctccaaggatgagaagacggctgcggcgtcctatgaatttattaagtggtttaacaacaaagaggatcagaccatccgtctggaacagctaggtttgattccggcctctgtaaatattgattatgattctttggaactgtcaccactaatgatggagattttggatatgaaaaacgaagttaattatacagtaagctcctgttggagagtataccctgccgcagtgaccgctattattcctcaggaactcgctgcattgggaacaggacagagtacgcctgaacagtttgcagagaatttaacaaatgcatcaaactaaacgtatccctgcaggaggagtgtaacagttcaggcgggcctgaactgttacaaatccagcccattgtaattcgcctgcggcgatggggtactgtgcgccggtggcgcacgtttagtacggatcgaagcggagcggagataggctgcctgcaaccaccctgttttcgtacggtctgctcagtaaatacgcagacctgtctgaactgttacggaggagcatctatgaaatcaaaaaaaactaaaatctggcttgcagcctttttggctcctacgctgatcctctttttggggttttacgcatattccattcttacggtgggaattaccggatttacagattggaagctgggggagcccataaggttcgcaggtgccgataattttataaaaatgtttcaagattccactttccatatatccttaaaaaatacaatggtatggatggtgctgcattgggtcatattagttggaaccagccttttggtggcattggcaacgttaaaaaagtcacgcttatcaaaagccgtgagagtaatctatctaataccgaaaatgatgccgctggcagtgatcggttttttattctacttcatgtttaatccatctatcgggctcgtaaatgatttcattcgtaaaataggatttgaggattttaatgtaaactggtttcaggacgcaaggactgcatttttggcggttacggtgacgactattttctatgggggagtttttatgctgcttatttcttcagagatagcagcaatacccacagaagtatatgagtcggcaaaagtagacggagctacggaatcccaaatcaacagattaattgtgatgccgttgatcaaaaacatagtgggaacatgcctgattcttgcaacggtagactgcctgaaaacgtttgaagtcatatatttgactacgaacggaggcccgggtgatttgacaatgaatctgccggttatgattttcaggaccgcaatgaataattccaattatggatatgccaatgcaatcgcatttgtgacgattctgattggggcagcagcaatgctgttaattacaaaagtgttccgtataggaaaagattaaggagtagttatgaaggcagaacaaatcattggaaaattaggaagaattgttttcttggtatttataatcgcaatatccactgtaccgctcttatggacgttggtttcttcttttaaaacaaataaagagattatggattctgcattttcgttaccggcatctatcaatcttgacaattatattatggcatttaagtactcaccattgggtacatacttttggaatacatttataatcaccgttttctgtatttttttcggactaatcatattcagcatgtcggcctatgtgtttgcaagatttgagtttaaaggaaaaaactttctttttgcacttatcggtatgtcaatgctcgtacctacatctgcattgatatttccagtttacaagctgatgaatgcaatgaacctttataacacgaaaagcgggcttgtacttgtttatatggcaatcgcaatgccgtcagtattgtttgtcttaagaagttatttcctgacgattcccaaggaaatggaagaagcggctagaattgacggttccgggtttatgagaacctatattaccattatgcttccgcttgttaagccggcaatggcaacggctgcgatactgatatttatggcgagctggaatgatttcatttacaacctgatgctttcgtcaggcaacaatgcaagaaatgtatcggtagcattgtcccagtttttgagtatgtttggaagcgactatggacagctgtttgcggcatcgtttatcgtagtgctgccaagtatactgctctattgtctgcttcagaaaagaatagaatccgcacttttggcaggtgcagttaaggggtaacagaatatgcagattgatttagcaaaatataaaactaatgtaaaatacggaaaagaggttatggggccgtcaggtgtccccggcgcttatgatgagatggcagtggattgtcccttcgtattttatcacaataatcaatactatatgatgcatgtagggtttgacggaaaaggataccagacaggcctggcagtaagccaggatctgcttcattggaagaaagaggagattatattcaaaagaggggaacaggaaggctgggataaaggtggagtcgcaggcatgtggatcctgaaagaaaatgatctcttcacaaaaccgtccttaaaaaaggtggatggaaagtactggatgatataccatagctatccggatgaggggtacgaggctggacctgcccaaatcggacttgcttatactgaggacgaaacgctgcatcactggacgcgtctggacaaaccggtcctgagctggaaagacggtgatgactgggaaatggcagggctatataaaggctgcctgatcgaaaacgacggaaaatattatatgttttataatgccaaagacagcaaggtatggaaatggcatgaacagatcggaatggcggtatccgatgatatgttggaatggaaacgggtatccgggcagccggttatctgtaatacaaaacctggctgggattcgtacttttgcgctgacccctgtgtggttaaggatggtgaattatggctgatgtattattacggatatgatggagaacatgcacaggaggggatcgcattttcagaagacttgtaccactgggagaaggtggataccccaattttaaaacatgggaatgcaggagagatagatgaactgcatgcacataaaccctgcgttatagaaaaggatggaaccttgtatcatttttattgtgctgtaagggaaagcaggcaaaatgacaaggctgtcaatatagatcctacccaagagcagggagaagaaaaaacagagtatcgctgcatatctgtagcaacaagccgggtatagcgagtaccaagtgtttagggttatatatatcgccctttacaacaaaaagatatgccagacgaatatagaaataggagcaaccgcccgcaaagtagttagcctctctgattagtaaaaagcctgcttagtactgcaaagtacagaagtaggcttcttaatttcgcttattattcctatctatttgggcaagcagtgcaatatgaatgatatcaaaatcaaattatctgcgccttcgcttcacagaaacaacagcaatcccgcatgctgcgagcaatgcaattatgtagaatatcatgatactgctgtcgccagtttttgggctgacagcttttgtagcagttttaggcttttcagtagtctgaggtttggttgtgttatccgttttccccttatcattgttctggtttggtttattattatccggtttgttatttggcttatcatttggtttattacccgcctcgtctttcagcgccggtattgttaaattaatagatacataactaagcccttcaccttttgttaatcttaacgatccttcttcaatcaggccatccttgttttcctgggctttgatcattttgaagtcagcataccactcgatgttgatatctttacctattgcattttttacgacattataaatatcatctttagttgtattgttcgatggtacaaatgcatctaaagcgtcatatgctgcctgctttgctttttcaatatattcctggtctgcgttcggatcattctgaggctcgtcaagtttagggattatcaaatatacgggtagtatagtgcattcacttcctacgaataaccgtatctcgcctgtgacagcgccttcttttgttgtagtagcttgatgaattttcatttctgtgacccaatctacatcggcatcaggaccaatcgcattttttactaattggagaatccctggagcataggcattattcgaaggctctatagcctttagagccttttcagcattagctattgcaatctccaggagctctgcatcggtcataggccttttggggatggtaaagtgccaggtaaaattctgactgttgtcttcccctgctgtcatttgaaagcttatatcaaatgagccttcctcctataattcttcctaacaggtcccgggaatctgttctccccgattttctcccctaaatcaattattcacaggactgccggacatagttttactatcctagaatactatataaatctcattctggtgtgatttagaaggtttgttgttatttgttgttgttttctgcaaggagttggctgtttcttgggaattgatatctgcgtttggttcgcagcaatataaatctataaaagcacccccagctgaaattatgtttatcattagtatcatttcagcgggaggcgctttagagtgtgtttgatgtgtcagagaaccgcatattccataaaagctcaagatatacttaatatttcatctaataattcctgatataagtccatataatccttaacgatatatggtttcaaaagtacggaaagatttttcgaaattggtaccggcgtaagcccttcgttataaaaaggcatgcattccataagccagccagctgtctgtgctgtaaaggatagagaaagaattcttaattcttcagcagaaaattctttattaataatgtctgcattttgaagcgtaataaaacaggaattatagtaattataaagctttatctggaagtcaaatcccttactcttaaaataatccgagctttttacaagatcattaagatttttaaaatagaacggaaaacgctgttcattctcttctacctttttaaatgacaagatcaaatcttttaacaaatccacaccggagagttctgcattgagatatatctggaaatcttcatggagttccgaaacgatctgtatcacaatatcttcttttttagggaaataataagttaagtttcctattgttgtacccgcatgcttagcaatttcccgcatgcttacctgatcatatcctttttgattaaataactgtgccgctgcatcgcagatggcctcttttctattgatacgcattctatatcaccttttttcatcataatccctattctatcaaaagacccggagaaagtaaatgcttaggagtatatgcaaaactgaacaaatacgtaaatttccatataatagtacaatgtactaaataatgattgacaaacaaattagtacagtgtactataaagaaaagaacaaataaacaactacatacaggaggtagaaaaatggaaatcagaaaacgtccgccagcccaaaacatggggagaattttagccgggggaatggcagcagaggattttatcgtgttaatgaaccgcacagagcttaactgtgaaacatttgaaaaggtatcccccgaggatgcagaggattttgtagcagtgtgtgaagatctaggcaataaagcaattgcctatgccgaagaacacgagaaacttggtcataaacaaacagcaagcgactactattttaatgcatgctctcttttcagaattgcagattatggtattcgtggagtgaatgaagaaaaatttagaatttatggtaaattagtggagtgcttccataagagtaaagagctaacctgttatgaaaaagttgagtttgttgagatgccgttcgagggaaacagcatgccggggtatcttgtgctgccggatcatattgataaagagacgccggtgattatttatgtccccggagcaaccggttttaaggaggaaaattataccgcgccaaaaaaactatgggaacggggagcagtatccatcatctttgacggcccggggcagggagaggccctattaaacagaaatatgtatttaacggcagataattatgacagggctataaaggctgtcgttgactttattaaggcggatggcagattcggtaataagattggacttatgggagtgagttatggaggatatttagctgccagcggcgctatctactgcggtgatgatatcaaggcgctggtatcccgcgggggatgctccaaaacagaccagctcactatgcatccatttgcgggaatcgataacttctacctttacggttttcttccgaagtttcacgttacagacccggaagaagctgcggctataagccatcagatggacattgaggataagttatataaaatcaagtgtccattgcttgttcagcatacggaaaaagacccgattatcggaacagaaggggcaaaagcgctctatcataaatcttcaagcgaggtgaaagagtattgggaacacgaagggagtatgcattgtgcaaatgatatagagctgaaagcatgtgcatacgctgttgactggattttagatcagttaaaataatcagaagctacaataaatctatgccttaggtgattcatattgtatacatgacactttaaagatgaatacacacgcaggaatacatacgcaggcacattattatcaatgaatattaagactgcaccacagaaggtttatcggttggcttagctgaccgataaacctttattataatagggaattgcccggcagacattgttcttttctgctcatattggtaattgacaaaatgatatcattatgatatcattcatatataaacaagaattacttattaccaggaagtgaaagagagggattattatgaatgaaaaggtccttagtacaaaaaagaatggcatgctggttttgattattacgatactgctctatgcagcagccattgcaggctgtatcttaggcggtgtgatcgtaaatgacggcggactgccggttctgctgattatcagcataatctggctttgcatcggatggcttccattctgtggcctgaaggtattgaaaccgcaggaagcgttggtattgacgctattcggtaaatatgttggtacattaaaggatgacggtttttactttgtgaatccattctgcaccagcgtgaacccggcagccaagacaaaactgaaccagagcggcgatgtggacggcggggcacagaaggcattcgcagtcactgttaaaaatgaaatttccgttggggaagcttccagcaaaaagatttctctgaagatcatgacgctgaacaataaccgtcagaagatcaatgactgccttggcaatcctgttgagattgggatcgcagttatgtggcgggtgacagataccgcaaaggcagtatttaatgtagacaattacaaggaatatctgtcattacaatgcgacagcgcgctccgcaatattgtacggatttatccatacgatgtggcgccgaatgtagatactaccggtgatggcgttgcggatgagggaagtctgcgtggttccagtgaagtagttgcttccagaatccgggatgagatccagcagaaagtagcggacgcagggctggaggttatcgaagcacgtattacttatctggcgtacgcacaggagatcgcggctgttatgctccagaggcagcaggcttccgccattatcgatgcaagaaagatgatcgtggacggtgcggtcggcatggtggagatggccttggaccgtctgaacgaaaaagagattgtggaactggatgaagaaagaaaagcggccatggtttccaatctgctggtggtgctctgcggcaatcatgatacgcagcccatcgtaaacacgggaagcctctactaagtatggcagattccaagaagaaacaggttcccctgaggttatccgaaaaattgtacaatgccattgccgcttgggcggaagatgattttcgctctgtgaacggacaaatcgaataccttctgacagaatgcgtaaggcagagaaaaaaagatgggaaatacgtttcagagcatttggatgaaccaccggaactggatattacgtagcgcaaaggggtctgacccctttgccgaaaggtttgttctctttaaagattaatcagttatataagagaggttttcagcataatactggaagcctctttttcgtttaaggcggggaatttgaaaatcaacagtgttattaatgaaaaaatttactgggtgcaggtaaagcagaatgatataagaataaatagtgaaatgtttaaaaagttgaaacaggtagtccaattacagtgtctaataagtagaaagaggctgagggagggaaaagagtggaagagctggttcgaaaagcaaaacagaaagacccggaagcatttacggagctgatgcggttacacatgcagagcatgtataagattgccaggtcatacctttcctcggatgaggatgcggcggatgcagtgcaggagacgattctgacctgctatgaaaagcttcctctgctgaaacaagacaaatatttcaaaacatggatgacaaaaatattgatgagaaaatgttgtgatattttaaagcgacagaaggtcattgattttaacggaaaaaccgcggagcagggggcttgtgataagtcctttgaggaattggaatggaaagaagtcattgggcttctggatgaaaaataccgtctgatcatggtgctgtattatgtggaagggtttcagacaggggagatcgcccagatcctgggtatgaatgaaaatacggtgcggaccaggctgaagcggggcaaggagcagatgcaggatgtatatgtaaaaaaatcaggaaggaggaaaccgcatggacgaaaaacgggagtggctggggaagctacaggaagaggcagaaattccggaagtcgtatggaaaaaagttgagcagacatttgatataatccgggaagaagaaatatacagggagattcccaggcgtacaaataagagcaaacgcaggcgaagcaagaggacaatggcagttatcattgcagcggcagtgcttatggtcagtacattgacagttggggccgccaaatattttcactggaacgacagcttttctaaaagatacaacattgatcctgaaacagagaaaaagctgaatgattcgaactctgcgaaggaaatgaaccagtttacagaacatgacggtatcaggatagaggcagtgcaatccgtagcagacagctatgcggctcatattgttttgatgatccggggaagcgaggggttcccgcttgagagccatatggggtttgagagcattgatgtgcaggtggaagggaatgaaatgattggctgggaggggagattcctcaaagaggtgaccgaggattggtcggatggagtcgaatatgaaattacggtacaagatctcggcgaaaaagggctgttaaacaaacctattaagctgtcatttcacaaaataacagatgaatatacaggaaaattaaaccgaaccgcgccgcctgtactggtggatacctcctgggagcttacactgaatctggataatgaggataccggtaaggtatacgaggttaaccagaagatacctggaagcgaagcagtcgccaaatcgcttcgtttgtcctcaatctcttatactctggatatggaatggacgtatcaaaaagagactttgtcgggcattgattccaacacgggtgaggaggcagaatttgaacatgtcaagaacccgccaatgcttatggggcttgtatatgaggatgggagtgtacgtgaaaatgtacttctccatatgagtggacattttaccaatgaagaaagaacggagtaccgggcgtatgggtataattatgagatggctgagtatgaaaatgtgagcgggctgctcttttttgtgggagaagaagtggtacgtgtgccggtggagaagccggattaaagagaagaacttaaatgccttttacaggagcagtaggacacgcataagtgagactgctcctgtttttatatgatagaaaagtgctcggtactttcctgttatataaaaccctctgggggatgtacaagcctcgataggtatatagccgcagggcggcatcacggcggtgccaaagtgtgcacttttacaaaattaacataccttaatttttagcgttagctgaaaatccgcccggcaggggcattagttacgtggtgcccttgggtatactttacttggaaacccctacaaaatctcaaattctttgaattaaacttgcgaataggcattgtcttcagtggcgcgctttaaatcctacaatcggccagcctctatcagaagtctggtcagatcaagtacgttctctgcgccttcaattcggccttcttccctgctgacttctctttcctggcgcatatgtttttcttcatcatattcttaaatactcacgcttttcgcctccgctctgtttttactcaggaaatctgccagaatgccatctgggatgcattcggtaatcgctctttccacagcctcctccagttccataatctttgcgtatgtgcgtatctttgtggtaaatacagaataatcatgtaaagttttgcagctatccataagttgttgattatagcccagattaatgttcgacattctcaagcacaggtgcctcctcgtttagcatacatatcggataactttaatgtctgcgattccggttgttcataattaccattgtagaagattacaaacctgggggcaggttgggactgcaggttgactggtgttcataaagtgccagccttgagtcaataataaaagagatatcattatgcatagacaaatatatagcattctccaaagtattaatttgtaataattcgggatcatcatagttagtttcgttcattgcattatataattgaagcaactccttcttatcacggaatcttagttcaaataacctggacttataaagacggtttgattttggctgcgcagcaatactcatatattagtgcctccttagtttttagtgcaagaggcctgaaaacattgtccagttttatgaaacctcgctgctatagttgtgggtttacaagtattgagatttctgcggttgatttcctgtataaggaagaatggcttcagatgtgatggctgtcacttagaataattagaaatataatgctttaaactaattttagcatagagtagtttttttaactagtctatttgtaatataaaattggagtttgggaaatgaaagttactatacacgcccgaagggcgcgaaaaccaagcagcatttcagaaaaagcaacggtaaatccatagagtatctttataccacccattatataaagaaaaaagaaagtagccggaaactaacgacggtggagaaaatccggctaaaaaattcctaataatcatattttagaaaaaggactaatcctcttctttcaagcataatatacagtactaatgtattgtacaagcgtgaaaggagagggtattttgtttgaggaaaagtcactacatgagatatcagatatgctgcatacggacagggaaaagggcctgtcggaggcggaggcagcgaggcggcttggggaagacgggccaaatgttttaaaagaaggaagaaaaaaaacggccgtagagtcttttctggagcagctgaatgacccgctcatctgtgtactccttgtggcggctcttgtttcctttctgctgaaggaagtgagcgatgcaattattatcgctattgtgattgtagtaaatgcaacggtaggcgtgattcaggaagggaaggcccaaaaggcactggaatcgcttaaaaagctgacaagccccaaggcggtggtgagaagagacggtatgatacgggaaattctggcttcggatctggtaaaaggagatattgtccttttggaggcaggagctcaggtggcagcggacctgcgtcttgtaaagacctggaacttgaaggtggaagagtcggcactgacaggagaatccctgcccgtgagtaaagatgcggcttttcaggcggacaaaccgcttcctgtaggagaccggaagaatgaggcatttatgtccaccttggtgaccagtggaagaggggaaggcgttgtaataggagcaggcatggatacggagattgggaaaatcgcggcaatcatcagtgatgtcccgaaagaattcacgccgcttcagaagaaattggccggattgggaaagatgctcagtatcgtatcggttcttctatgcgccgccctgtttgcaatcgcagtcttccagaaacgtaacatcctggaaatgctgatcacagccatatcgctggccgtagctgctgtgccggagggcctgccggctattgtaaccatagtattggcgcttagtgtttcgaagatggtccgggtgaatacaattgtaagaaagctcccctccgttgagactcttggtgcggtcaatgtagtctgctcggacaaaaccggtacactgactcagaataaaatgacagttacgagatattttgtaaaccaaaacatttacaaaagcagccaaccagcgcccaatatgccggaagagtttgtggaaggattaacattatgcaacgacgcggttataacggatcgggaagaactgggagacccgacagagcttgccctgctccgttttgcccagggataccgttccaagggcgaggcgcagtcttcgggacgttcccaaaaagaagcgctggaggccagaatgccgcgggtaaacgagaagtcttttgattcccagcgcaagatgatgactacggtacaccaaagtacacaggggcttaaggcttatacaaaaggcgcacccgaggttatattgggaaggtgcagtaagatcctgatcaatggaaaagtacagtccctgacagatacccaccgaagacagatacggcaggccgtagatgacttctcagcccaggctctgcgagtactggcagtcgcagttaggaagggcgaaaaggacgtaaaagaacaggatatgacctttatcggactcgcagggatgatcgaccccgtcaggccggaggcaaaggcagcggtggagcgctttaaaaatgcatctgtacgtaccgttatgatcacaggtgatcatattgataccgcatttgcaattgcaagagagcttggaatcgcaaagaagctggatgaatgtatgacaggagaggaactggaaaagacatccgatgtccagttgaaagagaaattaaaaaggaccagcgtatttgcaagagtttcgccggagcataaggtgcggatcgtgaaagcgctgaaagaaaccggaaacattgcggctatgaccggagacggtgtgaatgatgctccctcactccgtatggcggatatcgggatcgcgatgggggttaccggaacggatgtagccaaaaatgcggcagatatgattctgacagacgataattttgctacaatagaaaaagccatagaagaaggacgcagtatctatgaaaacatcaagaaaacggtactgtttctattgtcttcaaactttggcgaaatcatcacgatgttcaccgctgtcatccttgggcttgcatcccccctcaaagccagccatatactatgggtcaatctgatcacagactccctgccggcgctggcgctgggtgtcgataaaaacgataaggaagccctgatgaagatgcctcccagaaaggcaaatgaaggcttattttcaaatgggggaaccgcctgcaccattttttacggctgcctgattgcggccataagcctgaccgcattcctgaaagttccctgggacatactcgcctcgcagcaaaaagcatttaccctggccaatatctcagttatctttgccgacgcggatctgctggccagagcacaaacctatgcatttaccgtactgggaatgtctgaactgttccatgcactagggatgaaagatatacacacttctgtattttccagaaaacgggattttaacgtggtgatgcttgcttcttttggtgcggggttcgtcctgcaggccgcggtaaccgagatcccctatcttaccgctatgttcgggacagcggctctgtccctcggagaatgggtatccctgattatcctgtctgcattcccaatattggcgcatgagatattcgtgctgctgggagtgacacattttggatcggccagcgtcaaacaaaaactggcctcagaaaacaaaaaaatcagcccgcaagcggatggggttaaataagaacggatatatccgtaaaatacaaataagacgcgcttttcgcaggaaagcgtgtcttattcgtctatattacgatattttgcaaaggggtcagacccctttgagtatacattgttccgcagcttgctggggattcgcccgcagggcatgagttacggggcgccctatgggtttaattttttccccagcatctccggattcgaagcataagtcagtgcagtatcccgggatatttttccatctttataaagctttagcagacttgtatccattgaaaccatgtcttccttaacagaactataaataatgccgtcgatctgatgcaccttattatcccggatcatgttccggattgcaggggtaacggtcataatctcgaatgccggcactacgtttccatccactgtaggaaccagctgctgagacacaacggcattgagcaccatggaaagctgtacagcgatctgccgctgttgattcgacggaaatacatcgataatacggtcgatggtatttgcggcgccgatggtgtgcagggtagagaaaagcagatgccctgtctctgcggcagtcatggcgacgttgatcgtctcgtagtcgcgcatttccccaagcaggatcacatcggggctctggcggagtgcagcgcgcagggcggtgacgtaattgtctgtatccacgttaatttcacgctggctgacaatgctgcggttgtggcggtgcaggaattccagcggatcctccagggtgatgatgtgttcatcccttgtcttgttgatctgatcaatgatgcaggcgagcgtggtagacttgccgctcccggcggggcctgtaacaagtaccatgcctttgccgctgttaccaagctggatgatataatctggaagcccaagctcttttggatccggcaggatgaacgtgataacgcggatgaccgcggagagtgcgcctctctgtttataagcgctgacacggaagcgggaaacgccctggatggcgaaggaaaagtcatcatccccatgcttgtggagctggctgatatcgcggttgtctgccaggcggtatatctccaccagcaaactttccgtatccggggggagaagcctgtcttcatatatacggttgatgacaccgttcttccggcaggagacaggcagcccggctacgataaaaatatcggatgcaccattggccacagcctgttccagtattgtttttgcgtccataaatctattctcctttaattcgtaacagttcaggcagagctgacggttacttcaatttcactatttaataagttttaacgtattatctcccttccattctgcctgggaaacgactttccactgtgtaacccggtagaagccggcctcttctttgtctgcaggcagcagttccagtaccacagataaaaattgtttgtcattaaccggcacctggtaagacacggaaggtttttcagcagaaatgttcagctccagcacaacatcatcggtatccacaaccggcgtcagtgcagagagcttcttctctactgttgaataataggttccgcgggcatttttgtaagcctccgcaagaactgtatcaatctgatccagtatggtttcggcctggctggaagccctgtaatagtcggttttgcgttccgccagcctgctgctgaaaccgtagtcgctgcgtgcgctggagagggacagggtcgcaaatgttaccaggcacagcaccagaaaaataaccagcaataaggaggaaccgatatttacaacgggagaatgtttcttatttccattcatgatttatccctcctttgcagatgatgggagatatccagtgaatagatgtccttcccgtcagttagtctcttcatggttattttggcgtgaagcataaaatcttcctgggaaagggatatgtccagcgtgtaggcggcatcattctgcccggtacgggaaaagttctcatcataaaaaattgccgccttttccataccgataacttctgaatccggatattccgaacagatcaaatcgattgctgactgctgatccgaagaggcattcataagttccgcaatgctggatacttcattggcggaaacctggagttcacgcgattcctggctcagcagatgtgattttacaaaaaattgtacgcaaacggcacttgcaattgagaaaaacaagattgcaagaatcagttccaagaggaacagactggaagatttggcccggtttctgcgtgtcatagtgctctccttttctatatattactgtgcttcggtgcttcttgccgttacgacagaggcagcattctgccccgcatcgtctgtacaggtgaagcggaaggtatgatcacttacggcctccatctcaaaggactttacctgcaggatcggcctgccccgggaggcatcagcctgtacgccttcttttacaaatagctcttttaactcatgttcatcggtgtagatataagtaaagtaagatgccccatcgtattcctgctccaggataagcgcatccagtccgtcaaatgtccccagtgaaacactcccgttctcatcactctgatggatcttttcgctgatataggacagtgatgtgccggccgtataattcagagacgaatgttcggtggcagagcggtatatattggtggcaagaaggatgactgtcagtgcggacaccgcaaacacaaagaacagcgctactggaaataagaaatcaatcatgtggttcttccgggttcgaaaacgcatagtcagtctcctttctcaatgattgttacatcgggcaggatgttggtgccgacaattttataatcaacaaaaaatctatcttcatcgtaagtaataccataatgttccttcagatattccaggctttccggataactgccctccacggcataacagtaagtgatactgcggttcagcgcattttcgaggctttctctctgacggcgcacagaaccggaggacagcgattcaatgccctgataaaatagaagcacaatcagcagaaaaacgcagactgaaatgataaacttccgatatgtatgctgttttttctgatattcaaaacgtgccataagaacctccgtttaaatactggacatgattcccattagaggaagcatgacagaaagtaaaattacgccgacgatcagggagagcgctatgacaagtgtaggctccaggacggcaaggctgttattcatacgggtatcaatatcatcctgataaagccctgcaatattgtccatcacctgatccatagaaccagttttagcgccgatagaagccattctggcatacattccggttaaaatacctgtgccgtgcagcgcttctgccagatcctgcccttcatcgataaggctttggcaggcatcaatctttttctgaaaatgcacgtcgtcattcagggcgctgaccagttccatgctgcgctccggattcaggccgctgctgagcgtgagagccataccgctggcaaacctgcaggcagcgatctcttcataaataacacgggtaaacctaaatttataaccaatattacgggacatctgttttccactggccgttctggtgccgaaaagaatcagtgccgcgatgacgaccagaatggcaacaaatacgatagaataatgattgatagcattgccaatccccataagcgtccgggaaaatccggtcatctcggtgcccagctggataaatacctgattgaagatgggcataactttcacaagaagcacaatgatgaccactaccatcataccggccataataagcggataggttaccgcatttttaatacttttggctatagagtcctcacggtcgtaatgctcgctcagtgcagacatgacctcgtcaagggtgcctgtctcctcgccgatctgtatcatatgcagcatataggacgggaaaagccttgtattctcaagcgcctgatacatgcttccggtttcctgcatgtgatccagaattgcctgcaggatgtctttttcacctgcggaggcggtgtcctccagcatgattgtaataccttccagagaggagatgcccgactttaatatcagggcaatctgcccacagaaggcagaaatctccatatttgtaaatggtttttcctgtacttgcttctccatagtgtgtcctccgttatttttgaataggaataaacgttgttataagaataaaattgctaataagaatactttactgtgtaatgactgccgtctcctatgtattttccgactgccttcctgctgttatttgcggcaagagtcggatccataagggaccagcttttgccgtcaaactggatgatcttatcaacccagcccttttccttcaggtaaacgcttacccatgcgtggtatgcttctcccgaatatccgacttccagtctggtcggaactgactgtgagcgaagcatagcggccatcagcgaggcgtaatcgaaacaaatgcccgtcttatcttttaaggtctgatccaggttgggcaggtagtcggtcggaatgttttccgctttcttatcatcatatacaatattctcaatgacgtagtgatacacgttctgtacataactaaggtcatcggaggacttatcagaaatctccctccccagcttaacggcctgggaatcctctgtaaaccacacgtattgattgggatacaggaaaggcttaaactcatcactgatattgacttctatatcctgggaaaatgcgagtgcatagaggtcgtcccggacattttccaggatatccaggtgataggagccgtttcctcctgtaaggggaaaggtttcataagaacctccgcccagtgtgtaagtgtaaacggttccgtcaggtatcgtgatctgcagtttgaccttggcggcgctgccgccgtattgtaccataacgtagccttcgcctgtattggatgcatcaatagaaataatttcatttccataaacggttgaacccgatgcctgcggagtaagaatctggagcgcgctctgcctttttttaccagtcgaagcggaggcgcttgaaatgtcgccgtttcccttcgaacagccggaaaaagaggaggccgcaatcataatgagcagaacagcacttaataaacgtgaactctttttcattacatcaggcctcctctcagggtttctgtattattccctgattgtcagaatcaggtgaagcgtattgccggccttgtccggcacataaatgttaagcgatttctcaggataatcaaatataatatagttcccctcttcatcaaaggagaccggttctacctcattaccgtcaatatccaaagcagagatattatcgtagtccactccggagccgggatcggagagatacagatagatctggtcccccacctgcttgtcagaaagaaccaccggcgaggtggtatccacaccgctcacctcacaggtgatggaggcgaactggcggttttttagcgtaacggtaacggtcatggttccattgagtgtgggttcgatggaatatgtcttttcggccacttcatataccggaatattgctgccgcctatattggctgtgatcctgctgaccggtataaatgtatctacaacaagttcatatgcaggtttgccgtttgtaccatgatcctttaagttcagctgcatattaggtgcgatgaacagcaaaggcaccatacaaaaaaataacagaataattaccagcagaaccttctggagcaaaaaacgctctcttcggtaattactgtaagatttcagcacggaaagaggaacggtattgggttctacctcacatgcatcaaatatattttcaagcatctggctggcagttgattcgtccagttcgggtcctcttgtcttcttaaatttgtctgtcaacattggtaaaactcacctccttaacgctccagtgcctgcgccagctttgtacgtccgctgttaagataacgcttcacggtacttttactgacctccattacatcagcgatttcctccagcttcatattttgataatacttcataataatggcctgtgattcagtaaatgacagatctaatatcttcttcatgatatattcacgttcatctacccggatgacctgttcttccggattagcatgatgcttcgcctggtacttgttaacagcgatatcttccttggtaaagccggtcagttcctggtcaaaacggttctgcttacggtgcatattaaagcagacgcggaaattgatctgattgagccaggaaatgaaaagcttagaatctcgaagtgtataaagattcttgagtgctagtatataagtttcctggagggcgtcctgtgcaagatattcatccttcagataattaaatgcaaaacggtattctttttgataagtggcagcatacaattcagcaaaagcgtcgctgtcaccggttcgggcacggctgaccagggtcgatatatagccataatctaattctgccatctattcacctacttcccgttatagtctcatatacttcccgtttatagtttcataatcttatatcccaaaggcaccccataacacatgccctgtggacgggtctgcaacgcagctgcagaataaggtatacccaaagggcaccccgtaactcatgccctgcgggcgggtctgcagcaaagctgcagaataaggtatgtatttaagcactgtatatcctcttatttgcgagtgcaataagatcggtaatggtaccggccttagtaccttccttgaaagcacggccgtatttgtaagcaattggatgggttcctgatcctgaattgtgagagtctacttttgtgtaaacccgttcgaggaaattatctagtttctcatcgcttccgttttcgaacaaagccataaatttgtttcctccattgcgcccgataaaacagaggtcaacggaggccattttgaggatgttggagaaatccttaatcagagcattcccctctgcgtgtccatataagcggtttatatcgcttacatttgacagttcaaacatgatacatccgatgtcagaaggcaatgcctggtcaagatacttttcgattagtgcatcgcagctgaaacggtttggaataccggagagaggatccgagtgtactgcaaagtccaggtcccggtagtctcttttaaaggaagagaaaaaattaaaatcaagaaaaagaaataagaatgacaatcctagcaccgcccataacagaccacaaataatccggatagacgggttcgtggcaatatattgatatacctccggatccattataatcttatatatacaaaacccggtcagaaagacgtagatgatcagttgtattgttttgaaaatatctagtttcttcattgatatagcctccttatttctctggacaaaatctcggaatcttcaattattaatactgaagatgttcaacaaacattttaattatatcacattttaatggatatacctatattttttcaagctactatttgtgtatatttcagattatacattaaatttacacaattatttaatattaagttcatgtaaatcgtattaacttaagaaaaaaattaagaaagtataaaaaatatgatccctttccagatatcaatccctctttatatatgaaacgtctaaatctgtaagtccttaatgttgagtaattcaagggattggattttggcattatagataaatgagaattataaaaaggaaggagaaagattatgaagaagaattttaaacgctggcttgctcttcttttagcggttgctatggtagcaacaagtgccgtgtattcgtctggaaattcactgaaagctaccggtgatccggagaatgtagagcagagtgaccagcagagcgagcctcagaccgtggatgagggaatgggcagcgctgatgcaggtatgcgtgattcggatgcagggacccaggaaactggcgagaccgactcaaaacaggtgatcgaactggaaaaaccacagggcgatcaagaggctgcaaagcaggaaacagagaattctgatcagaaggcggatgctatatccgatgcagaacagactgggggagctgaccaggtatcagggacagagcagaagaatgcttctgaaccggccgaagaagcgcaggtagagcctgaagtacagaaatacagtgttgtgtttcacagtcctgccgtggatgggggcagcttaagtgtttgggcagacggaaacgaaaaacaaagtatttcatacggcagtggaaattatacagaagaaattacagagggcactctgttaaatttccagataactgttcatgataaatatacgcttgaaggagtgacagatcagaatggaacagcaatcgctcctgtctcttcagaaggaaatgtttatacttatcaggttaccgtttcaggaaatctagaaataaacactttatataaggaagaaactcaaaaagaagaggcacagcaggaggatgcacaaaaaacggaaaagaaatcaaagatttcttccagcagtacaaagagtgtaagtcctctcagcatctccggccagcagtccatgtatgttggcgacactcagactttagcgggagaaggcagctggggaagaagccataactggagtgccagcggcagcggtagtgttacaattgatgctgacggatctaatgccagcattacagcaaccaaagctggtaatgtaacaataacccacacgtataagtggttcggtagccaaacagagacgttcaatcttgtgatttacgacaaggtcccactgacggggattacgattgccggagaagacagcgtaaatattggcgcttcgaagacattaagtatcacaccgacgccggcagatacaacggacaaaaccacagttacatggtcttcaagtaatgaaaaggcagcatctgttgataaaaacggcgttgttacaggtatcgctgagggcgagacggttattaccgcagtatcaacagtggataagaacattaaggcatcaaagacgatccatgtgcttcggattcctatgacgggaattcagattcatggcgaagatacggtgaattctggagatacattgcagttaagcgcagagtgcctgcctaaaaatacgacagatgacaagaaggtggtatggacatctgcagatgaagaggttgcttctgttgacagcaatggactggtcacggcaaagcggggcggttcagttgagattactgcttcatgcggagaatttagtgacaaacttgagatcaggattacacaggaagttacaaaagtcgaagttgtccttgatactgataagttgattatgggaacggcaacgaaggcaaccgcaaaagtgaatccttccgatgccacagacaaaatcgtcacttggagttctgacaacgaagaggtagcagttgttgatgaggatggaaatatcagcacagtgggcaaagggactgccaacatcattgcaacagcatccaatgggattgagggttctgcaaagttaatcgtggagcaggcatccgtgagtgttaccgctgattatctgaatcctgtaatcggagataaggttcaggcaaaggcagaagtaaaaccggagtggctgacggagcagatgaaagagctgcaatggtcttccagcaatgaagaggttgcagatgtcagtgcagaaggtctcattacaacgaaagctgtcggtaaggcggagattacggcttcattaaaagagaatccagagatcagcgcatctatagagattacagtgcacgacccggcagtgatatcttctcacacactgtctgtagagtttgtatatcaaagcggtggaagagttcagtccaccttccgtgcacaatatgtgactggtgagaaatatgaagtaacgattccggcaaaacagggatatacaacatacatgcaggaatctgacggatcactgggacaggaagtgtcaggtacgctgacggacaatatttacgaaaatcagaatcttgtggttgtttatgtaccggacagtgtagaatatcaggtaacccaccggttcgaacagactgatggaagttataaagaagagatcgagaaaaaaacaggttatgtcggtgaggatacacaggcagaagcaaaagacttagaggcatatataccgtctgaatttgagaatgttgagatcggcggagaccgtgatattaatatcactattacctataagctgtcagaatataccgtaaggttcaatacaaatggcggaagctatgctgccacacaatatctgaaacatggtgaaagtattaatgtagataattataaaccgacaaaagaaggttataatttctccggctggtacaatgattcggaattttccgatcgggtggccggtgagcaggtgattaaacaggatcgcacgttctacgcaaaatggactgccatagatgtaaattataccatctcttattggcttgaaaatgctgatgatactgattacagctacagcaaatccgttactgcaacagcgaaagcaggaacagagctgacagtaacggctaatcaggcgggaaccattgactactttacgtttaagaattccgaaacgaaaaccatagcagccaatggatccacaatcattaacgtttattatagtaggaatacgtatacattaacattctatgataatagaaagcaggtctattcggcaacgaaaaagtacaatgcagatatttccaagatgctcccctttgattcaaaatatgaaggccgggcatgggaagcaacctcttattatgattatgcactgcagactctggatcggatgcctgcgcagaatatcaagtttaatctgtacaataagtcatccgaccaatataaaaccatatattattatggcgagaatgtagacggaaacgggtattcactcattaaatccgtcggcacctattttaattacattacatatgaagaagagtatcatccgatacagggttatgtgagaagggacagcggatggaagagtaaagacttttcatatgaccggaataagaaggagtattatgtaaatctgtactatgacagggcgtcctatgatctaacgttctataactataatggtatagagaaaacacagcctgttacatttggcgtctccttggaatcctataaccatgaacctgccagaccggcgaatttaccggaatattatacattccagggatggtatacttcggaagactgtacggatggatcagaggttgactggagttccacgatgcctttcaatgatttaatggtctatgcgaaatgggcagccggagagtatacagtagatttcgatacacaaggcggcagttccgtcgcttcccagacagtgccagcgggcaatacggtaatgcagccatctgatcctgagcgtgaaggatacaagtttgagggttggtatacatcaaaggattacagcgaacgttttgactttggaaaaccaatcgaaaaaaagaccacagtttatgcaaagtggaaacagattacaacaaccacatatacgatcaagtatatagatgaccgcgatggcagtgaattatttggctctgttataaaaggcggcaaggttggagatactgtctatgcatatccaaaggcacatgatgagttagttccgacaaaggccagtgcatccctcgaattatcctgggatagcaaaaagaatgtgattgaattccattattcaattccgtcagatgtgtattataaagtacagtatctggatgcggaaacaggagaagctttaattaccgaaaaaattgaaaagatcagtgctaaccgtgtggtggagacagcacctgtggttgagggatacgaagcagattctgtaagaaaatctttaaatcttgcaaatgaaacaagtgaagcagatattaaagagaacgtgatcacattccagtatacggttattaagaatccgattgcctccagtgtggtaaatggcacgatccagccttccggtacgacagaagtaaaatggggaggcagccagacgtatacgtatgagccatcctcaggattcgtattaaagagcgtgattgtggatgggcaggatgttacggcatcgaatccgggcagctacaccttcaacaatgtgactgcgccgcacaatattaaggttacctatcaggtagatttcagcgggtttgcagttagcggaatcgaaaaggaatatgacggaaactcctatcatatcggtttcaccggaaccacctatccaacagatcagatcgaatactggtataacggaaaactccagatgggcaatccaagctttacgaatgctggagagtatccggtaaccgtgaaggtaaaaagaggcagtgatgtgtggcaggatacagccacagttaagatcacaaaaagaacagctaatatcacagtagacgacaaagagaaattctttgatgaggcagatccggcattgacaggtaagattgagaatcttgtagatgcgggagatttgggtactgttacttataagagaagcaacacggacgaagcggttggaatctatagggaagtattaattgcagagtatactgataattccaattatatcgtgactgtaaaccggggggattttgagattaagacggcgaaagtcgaaggagcaagtcttacagcatccggcggcagttggccctatgacggaacagcacacggagcagaagcagcggttcagggagctgaaggatatactgtctattataaagtagaaggcggagactggagcgaagacgcgccgaccgtaaaagatgtagcagacggcaagaagacagtcagtgtaaaagcaaccagaagcggttacgaagatctgactgctgaagacgttacaatagagattacggcaaaaccggtgaccattgaagtaagcaatgcatggaaatacttcgatgacccggatccggcatttaccggaactgtaggggaacttgtagcagccggtgatcttggtgaagtaacatataagagaacgaatacagacgagaaggtgcaggtatataacgatgtactaacagcggaatatacagcaaatacgaattaccaggtaaccgtacttccgggtgacttcgaaatcaaaacggcaagtattcagggagcttctctgagagcagaaggcggcagctggccttatgatgggtatgcacatgcagcacaggcggcagttagcggggcagacggatacaagatcttatattatacagaaggtggcacatggtctgaagattcaccgactgttacaaacgtagcggatggaacaaagtcagtcagcgtaaaggcagtcagagaaggatatgaagatctgacgaccaataacgtgacaatccagatcacaccgagagatgcagtaatcacagtaaaagatgcatggaaatacttcgatgatccggatccggcatttgaaggaagtgtatcgaatcttgtagcagcaggcgatctgggagacatcagctacagcagaaccaataaggatgaagatgtagatatctataaagaagttctgacagcagattatactccgaacacgaattataatgtagatatcgtcaaaggtgattttgaaatcaaaaccgcaacgattacaggagcagaactcaaagcatccggcggaagctgggaatatgacggagcggctcatgcggcaagcgcagtggtaaatggagctgacggctaccagatttactataaagcagacggcggaaaatggaccaaagaagcgcccagtgttacaaatgtagcagacggtgtgaagacagtcagtgtaaaagcaaccagaacggggtatacagacctgacagctgaagatgtaacgattcagattaccgcaaaaccagtgacaattaccgtgaacgacagctggaaatattttgaccagccggatccggactttagcggaaccgtaggcaaactaatagcagcaggcgatcttggggaagtaagttacagaagaacgaacagcgatgaagcagtaaatttctatgcggacgtactgactgcagattatgaagcaaataccaactatgcagtcaccgtggagccgggcgattttgaaattaaaacagccagcattgaaggtgcagaacttaaggcaaaaggcggtagctggacatatgatggaacagcacatgaagcggaggggcaggtcaaaggcgcagaaggatatactgtatactacaaaactggaaacagcggctggactacggaagcaccaagcgtaaccgatgtggcagacggtgtgaaggcagtcagtgtgaaagcaacccgaaccggatatcaggatcttactgcacaggatgtgacgatccagattacaccaagggatgcaaccatcacagtagaagatgcatggaaatactttgataaacaggatcctacatttaaggggaaagtagagaacctgattgcggagggtgatcttggagaagtaagctatagcagaatcaacgccgctgaggcagtgggaacttatgaggaggttctgacagcacagtatgaagaaaacacgaactatcacgtaacagtagtgccaggtgactttgaaattaagaccgctaagatagaaggtgcatatctggaagcagccggtggaagctggaattacgacggagatgcccataaggcaagtgcagaagttaaaggcgccacaggttataagatttactataaagttggtagtggtgaatggtcagaagagattccaagtgtaactaatgtatctgaggggatcaagacagtcagtgtgaaggcaaccagaaccggctatgaagatttaacagctgaaaatgttaccattaccattacaccaaggccggttacaataacggtggaagacagctggaaatactttgatgcagtagatccggaatttaagggtgcggcagatgatctgataaaagcagatgatttgggaaccatcagcttcaaaagaaccaatacggatgaagcagtgggaacctatacggatgtactaacagcagattatgaagcaaataccaactatgatgtaacagtagctaagggagattttgaaattaagacggctaccatcgaaggtgctaaacttgaggccgccggtggaagctggacgtataatggaagtgcccgcagtgcagcggcagaggtgaaaggcgctacaggctacaccatttactacaagaccggagacggcggctggtcgacaaatgtaccgagcgtgacaaatgtagcggatggagttaagacagtcagcgtgaaagcaaccagaaccggttatacagacttggttacaaaagatgtgacgattcagattacaccgaaagatgcagaaatcaaagttacagggagctggaaatattttgatgacccggatccggcattttcaggaaccgtgaccggcctggtcgcaacaaatgatctgggtacaatttcctatcgcaggaccaatgcagatgaggcagtcggaacatatttgaaagtactgacagctgattatgaggcgaactccaactataatgtaacggttgttccgggtgatttcgaaattaagacagccagcataaaggatgcaaaactggaagcagccggcggcagctgggaatatgatggcgcggcgcattctgcacaggcagaagttcttggagcagaaggctatacaatctattacaaggttgggaatggagattggtcagataaggctccaagcgtgacaaatgtagcagacggcgtaaagacggtcagtgtaaaagcaaccagaaccggatatgcagatctggcagctgaggatgttacgattcagattactgcaaagccagtgacaatcactgtgaataacaactggaaatattttgaccaaccggatccggactttagcggaacggtaggcgagctggtagcagcaggagatcttggagaagtaagctacagaagaacaaacaacgatgaggcggtaaatacctatccggatgtactgaccgcagattatgaagcgaaccccaactatgcagtgacggtagagacaggcgattttgaaatcaggacggccagcatagagggagcagagctgaatgcggaaggcggaagctggatctatgacggaacagcgcatgaagcagccgcagtggtaacaggagcggaaggttataccgtatactataaggcgggggatgcagactggaccacagaagcgccgagcgtaaaagatgtagcggacggcgtgaagacagtcagtgtaaaagcaaccaggacgggatatgcagatctgacagcggaagatgttacgattcagatcactgcaaaaccagtgacaattactgtgaatgacaactggaaatattttgaccagccagatccagattttagcggaacggtaggcgagctggttacagcaggagatcttggagaagtaagctacagaagaacgaatgcagcggaaggcgtaggaacttatgtggatgtactgaccgcggattatgaagcaaaccccaactatgcagtgacggtagagaccggcgatttcgagatcaaaacagcgagtgtggaaggagcgtatctggaagcatccggcggaagctggccctatgacggaacagcccatgaagcatctgcagtggtcaaaggagcagacggctatacggtatactataaagtgggagatgcagactggaccacagaagcgccaagtgtaacaaatgtagcagacggagtgaagacagtcagtgtaaaagcgactagaacaggttatgatgatctgaaagcagaaaatgtaacgattgagattacagccagaccagctaccattacagtggatgatgattggaaatattttgaccagccagatcctatatttaccggaacaatagagaacttaattgcagaagacgatcttggagaagtggtttacagcagaacgaatgctgacgaagatgtaaacatctatcaggatgtgctgaccgcagattatgaagagaatacaaactattctgtaacggtaattccgggtgacttcgagattaagacggcgactattaaggatgcaaaagtaacggcggaaggcggaagctggaagtatgatggtcaggctcatgctgcaagtgctgaggtaatcggcgcagacggctacactatatactacaagacagcagcaaatgactggtcaacaaaagtaccaagtgtaacaaacgtatcggaaggaaccgtaacagtaagcgttaaggctttacgggaaggctatacaactctgaccgctgaggatgttacgattcagattgtggcaagaccgatcacaattacagcggcaagcgctgagaagtcctttgataatactgcattggtgaaagcagtcagcacagtaggcctgggacagttattaccgatacacaaatatacggcaactgtagaaggcagtcagacatttgtgggaacaagcgacaatgttgtaagagacgctaagatttatactctggccggagaaaaagatgtaacaagcaattatgatattacttacgtaaagggtactttgactgtaacagatgaggatgtcgatgttgatgacgtagtaacaaagactcatgacggagagaagacctataaatatggcgatacgatcacctttgatatctcagttaagaatatctatgatgaggctaagacaattacaatcgtagagcaggatggagtcacaatcacaggaaatgataaatttgtgaatgtagcatcgggtgatgtagtaacaacaacagcaacttacaaagtaacagaggaagatatcctgaacggaagtttcacaaacaccgttaccgcgaagttctcagacgaaaataaagactacgagaaagatgacacggttatcaaattcgaagatccgaagggacatttaactgtaacaaaagaaacaacaagcaagcctgcaaacggcgagacatatgctcttggcgagacaatcgtctacaaagttgtggcagctaacgacggaaatctgacgctgaacaacgtgatagtaaaagatgagctgaccggcgatgaatggacggtgggaactctgcagccaggtcagagcagcgaagcattcaaggctgagtataaggtaacagaggaagatatcctgaagggcatggtattgaatgaagctacagctataggtgaaagcacggatcctgagaatccaaatccagagatcgtacctggcaataccgaagacccaacagataatccgaagggacatctgaccgtaacaaaagaaacaacaagtacaccggcaaatggtgaaacatacgcacttggcgagacgatcacttacaagatcacagcagtcaatgacggaaacctgacgctgaagaatgtagttgtaacagatgaactgacaggagacgaatggaccatcgactcactgaaaccgggtgagaccagcgaagcgtttacagcgagccacaaggtaacacagaaggatattctgaagggctccgtagtaaatgaagctaccgcagcaggcgaaagcccggatccgaacaaaccggatccaggagtagacccgggagagacagaggatccgacggacaatccgaacggccatctgaccgtaacaaaagaaacaactagtacaccagagaacggagcggcatacgctcttggagaaacaatcacatacaagattgtggcagcaaatgacggaaacctgaccctgaaaaatgtagtggttactgacgacctgaccggagatgaatggacaattgattccttgaaaccgggagaaagcagcgaagtatttaccgcagaatacaaagtaacagagcaggatatcctgaacggaactgtactcaacgtagcaaccgctaagggagaaagcccagatcctgaaaaaccggatccgggagtagacccaggcgagaaggaagagccgacagtaacaccgcagccgagtctgtttgtagaaaagacagcaactgcagggccggaaggcggattcaaccttggagagacagtaccttacacaatcaaagttgtaaacaacggtaacgtaacaatcagcgacattacagtaaatgatgagctgacgggaggccagtggacaattgacagccttgagccaaacggaacgcaggagtttacgacagaatatgttataacagaaggcgacatcctggcaggccaggtagtcaacgtcgcaacggcgggcggtacggctccggatggaagtgaagtaacaggggatggaactgagaccattgaaacagagaattccaatccgcacctgagcatttccaaagagacaacaagtacaccggcaaacggtgagacatacgcgcttggtgagaccataacctatcgcattgtagcagtaaatgacggcaatttgaccctgacgaatgtagtggtaagagatgagttgaccggagacgagtggacgatagaatctcttgcaccgggagcaagcagcgaagcatttaccgcggaacacacagtaactacagaggatatccagaaaggttcagttctcaacgtggcaacagccggcggcgagactccggatccagaaaaaccagatccaggagtggacccgggagagaaagaagacccgacagatgatccgaacccaagcgtagcagtggctaaagaagtaacaagcacgccggcaaatggcgagtcatatgcacttggcgagacgatcagttacagagtaaccgtaacaaacgacggcaatgtaccggttgagaatatcagggttgaggatagcctggtaagcatcacagagaacaccatcgcgatacttgcaccgggtgagagcagagaattcacatacgaatatactgtaacagaagcagatatcagaaacggccaggttgttaatacggcagcggcatccactgatgatccggaagggccgaagggaagcgatgaagtcgtaacaccggcagagccggcagatgcggcatatacggtgaataagaccatagtgaacccgcaggatgaatacaaggttggcgacacaattcagtatcagatcgcggtaaacaacaccggaaatgttacactgcacaatgtagtcgtaagtgataaccttcagggggcatccggcagcgtaacatttacagacgctggtgataatactgttgaaggaaacaaagtaacaatcagagaaataaaaattggtgaaacagtagtactgaactgtgaatacctgatcgttagagaagatgcaggagctaccatcagcaatatcgcaagtgtaacaacagatgagactggtgagactccacgtgaagacgagacagaggaaacaccggttgtaaatatctacagactgaccattcattatgtagatgcagccggaacagcggtagcaccggattataccggcgaatatgaggtgggtgcagcattctccatcgcatcaccggcagttacaggctacacaccgaattatgcaaccgtaaacagcggcgcggatggtatgcctgcagcagatgtagaagtaacagtaacctacacagcgaacccggtcatcgtaccaatcgtaccgccggtaactccgacgactccggcaacaccagtaacgccagtaacaccggcagcggtaacgccgaccacaccaacggcaatcataccaccgacaccgacacctgcagcaccgattgacgctgaattaactgagaacgacgaaggcgactatgatttaacaccaatccaggatgaggaaacaccattagcaaaacagaacctcgatgaccacgcttgctgcattctccacttcttactgatgctactcgcactgattgtgctggcattctacacaagaagcatgaagaaacggcaggcgagaatcttcgaactaagagaagagcttgagcttgaaatggccagaagaggcttaggcggagaggaaaaggaagatgacgctgaataatcaaagcagcgcaagaccgaaaaggagggaaccatatgttgtataatttatatcaattcatacacaacagtttagggttatgcttctgggatttaccggcgctgctggtgggaatcatcatgatagtcgtattcgcagtgcataagcataatcagaagaaacgtcagaacaacttcgaagatgagctggaagaaaagatgaaagcaatcaaagaaggaacagcgggcgaggagcctgcgcaggcataacaacaaaggctgtcgccgccgtatccatccggcggcgggcagcacaaaatgagaaggaggaatcaatatgtcatatatcttttcacacaccgtgcttggtttttgctggtgggatcttcctgcattaatcgttttgattgttgttatcgttggatttgcggtaaaacaccacaacatgaaaaaagaggaaaatgatctggaagatcagctgtccgaactctacacaaacgatacggtagagattgacagtaaagtataattagtaaaaacaataaagctcctgggagtgacttccgggggctttttttagaatattctgaaaacggtacgcaaaggggtcagacccctttgcaatattcctgttccgaggtataatagggatatataatttaagtagaaagcagtgaattccatgtcaaaaagaatattaggcaaatatgacggtaaaaagcagaagtggctgcatgatattatcgagattattatcattttccttgttgtctttatcttgttcaattttattatcggtatatcgtttgtaaaaggaaaatccatgtatccaacgcttcataataatgagattgccttttataccagaattattccgcattttgagcggggggatgtgctgtctgttaggatgccctccggggattattatgtgaagcgtgtcattgcggtaggcggtgatacggtggacattaggcaggggaaactatatgtgaatggcgaagagatggaggaaccctacatcaacggggcaacagagaagaagatcggcggtgtcgagtttccctatacggtagaggatggtaaactctttgttatgggagataatcgtgaggaatctatggattccagagacttcggcgctgttatcagaaaacagataaagggaaaagtactgctgtacataggcagaatctcgtaaggtgtatggcggataatagagaatgaaaaaaggcttcacaggaatgctggcaaacggcggcattcctgtgaagtcttttttgtagaaacagaattcgaaataaaaacactttcatttaaaaaataaaaagaaataaacactttttaaatgtatatttttctgtcaaaattgtattttaataatacaaaggaaggagaaatatatggcagaaaaaacatggattaaaaaagtgaaagaatttgaaagggacttgatattaaatgagaaatcccccgcaactgtaaaaaaatatttaaaggagattgagaatctgttttactttcttgatggtggggaaattagcaagaaccggctgatagaatatagagcttcattgcagcgggaatacaaagcccagacaattaatgtaaagctgtcggccatcaatgcatttttggagttttcaggactgtctgactgccgggtaaaatttgtaaaagtgcagaaaaagtcattcatagaggaaaatagggaattaaaagaggatgaatataagtctttgcttatgtccgcaaaaaagaaaggaaatatccggctgtatcatattcttctcacattatgcgggacaggaatccggatcagtgaattaaggtatattaccgcaaatgcagtgctgcagggacgcgcagaaataaatatgaaagggaagcacagagtcgtactacttccaaacgaattgaagaataggctgaaagattatatgagcctaaaaaatatcagccagggatgtgtgtttataaccaaaaatggaaatccagttgaccgctctaacatctttcatgagatgaagaggctgtctgctgcagctggtgtagagaaacaaaaagtatatccgcacaatttccggcatcttttcgcaagaactttttatgcggtggaaaaaaatctttctcatcttgcggatattctgggacattcctcgattgagaccacgaggatctatgttgcatccagttacaaaaactttgacaagatactggacaaaatgcagctgataatataaaaaaccacagaatcaatattctgtggtggctggaggatctagatctcacggttatttcttgattcaccacgaaatcaatattctgtggtaaatgaaataagtttctacataaattcaattgcttatattatatatgaaaaatgacgaatattcaattatattttaaaaaagcaatatatttttaacctttttaatgcagtctgctattaattaaaaatagtatgtatcagaaaaagacctggtgtttttgtttaagacaggtctgattaactacgcccaaattatgatatgaaagtgcactcataagatattcccaatataaatttcaaatatattttcttataaaatatctttctctaccacagaatattgattctgtggtaattatgtaaacagtaaaaaaaggaagatttcatatggagaaaagatcccacatcacagccccgctgaatataaaatttcgggagaaatccatgctgccactctacgaggaaggcataaaaaaggaaataccttatacagaacccatcgtcgtatatttggcagctaaaaacattggaaccggagagatctacatgcccggcattacagaaatcacagcggacatggacggttatatcataatatatggacggagcatgggctatgaactgcatacatataagacacataagacagcaggggaattatttattgagctggcggcccatgccggacagggattatttggttatgagccgtggatcgaagcggtcaggcaagagttttttgaagaggcagaaaatatgatctcaggcggacaggactcgaacaaagaatcataattaacttcttttacgatgtgccagcgcaacagtccgggcttttaaaaattttttgccgcaatatgccgatacagagcagaaaaaattgggaggagaagcatatgagtatcatcttacaaattgtttccattgcagtatgtttacttatgttatacgggctttgccaggagatgaaaaaaaggcatctttcagaaaaccaggcaatcttatggatcgcaggggcggcgggcctcctgctgctttccatatttccacaaatactgccatgggctgcagagcttctgggaatctggtggccccctgcatcactgatctttttctttctcattgtaatcataatgataatcctgcgccatacggtcacaatttcttctatggaaacagaaattaaggaactggccatgcaggtagcccttttaaaagatgagaacagtgaactggaaaacatgttaaacagcaaaaccaaaggggagaacacgaatatatgaaggtattgatttgtggagaatacggtgtatactgcagagagctgatttccagactaaggaaagagaagcatgacattttcgtgataacaggttcagagaaagcacggagagagaagccaagaaccggagtttttcaggagtatcatttcagctatcgtagcaagaatattggtacaatcatgaaaaatgtgcaggctgatgtgctcctgatcctgggagtctgcgataccaaattcacatggcaggatatcaatcaggagtcggtgcgctatctgaccagcatcaccaatatcctgatgagcgcaaaggaagccggaatcagacaggtcatctactgctcctcgctggggggttatgatggatgcgaagatgctgtgatagataaaaacacagactttgaggcagactccatcctgatgcagacagtgatccagacggaatacatgtgtgcggagcaaaatatcccgggggagtttgatatatgcgttattcgctatccggaggtattcggagactataaaactcataattacaatatctgtgcaaggctgatggaaaacttctttaccagtacagagatgcaaattgaggcgggaaagcagcaccgggtgctgtttgtcaatgacgctgtagatacactgatgcgggtattcctgaccggagagcgggaaaagagttatctggtgccaggctccgattacacagaacgacagctcatcgaagcggtcaggattgtaataccaggcagagagactgtcatcagggaggctgagtatgcaggagcgtctctgcccgagatacaagatccgtatttggaaaggctgggaatctatgaaaagtacagtctggaagatggtctgagagaactgtttaaaatatttgaaaaagaaaaggacctggaaataaaggaagagaagaaaaaatctgtaatcaaggataaattaattcccctggcggaaaacgtagggctttttctcttcatgacactgcttacatacttactaaaggacacctggttcggcagcattgcagacctctatctgctctatgtagtcataatagccgtggtttacgggtgtgcacatgcgttgtttgcgacgctgctcactctggcggccaaaaccggcgagattctaataaccggcggcacgtttgattattccgcattcacagggatcctgcagattcttgtggtcggcgtaattgtagggcatatgagggacaaataccgaagaaaaaacggagatctggaggatgaaaaaaaatattaccagagcgaacttgtagatatgacgcgtatctatgacggcaacaggtatgtcaaggaaatttatgaaaagcggattgtaaactatgagaatagtatggtaagggtctatgaagcctccagccagctggatttctgggaaccacagaaggtgattttccaggccgtcgatgtggcgagggaactgatggacattcaggacgtagccatctacataacgggcggcagtgcgggctatttgaggcttgccgcagcttcgtccgaagaggcccgccagatggggaaatccattcatgcagatgaaaacttcttcatgcatcgggaactggttgagagaacagtataccggaacagggaggtggattccgtgctgccgtcctatgcatgtggaatatacgatagagagaatttgaatgccgtcatcatgctttggacaaaagacctctccaagattaatctttatgagtccaacatgctggcgctgatctgccggctgattgaatcctccatgaaccatgcggcaacatactggaaccgtcttgcgaaccaatatatagagggaacaaacgtgctgagagaagaagagtttgacaaaatgtgccagatctgccaggaaggttcccagcagaataagctggagtatacggccctcaggatatccggccggtttctgcagagcaggggaaaagaagtctttgcaaaaatagcctccttggtaaggcagacggatatcatcggtgaaaaagatgaaaatatctgcattcttcttatgaacacaaatgaatcggaagccaaatatgtgattcagcgctttcaaaatgcaggaataccggttgaaaatggaattggatgataggagctggcgagcgtggaaaacaaatggatgatatggattttgattataaatacgtgtctggcactggtgtatttcctgtaccggggcgtatggaaaaaagaataccgaaaagcagttcttttgaccgtatttatgatactgactccggtggtgggcactatctttttatcgtgcagtgaacttttcaattttattctatttcataagcgggacggtctgctgaacgaagaggagctgagcttcagtaagaaaagaacccgaatgattataggcgatgatatagagaaagagatcgaccgggtacccatagaagaggcgctgatgatttctgacaccatgaacagaaggcagctttttttggaggtactcaagcgcccggacgtggaggagtatatgggaggaatccagaatgccatggcccaggaggattcggaggtagttcactatgcggcttcctatataacagataccatagcgaaatacaaagatacggaaaaacgccttcgtacgatctatgaggaaagcaaagagagcgatacacttttgttgtatctgcagttctgtgataatatgcttcacaaaaaagtgttcagcgagccggagcagaagatctatcttaatttttttgaaggatatatggaagaactctatcagaaggataaaacgaaggtaaatggaaacatgctggcagatatcattgaattacggaatgaatatcaggatgcaggcggcattgaaaaatgggtgaaacgggcagaggatatcatggagcaggaccttgctgcggcaaaagaagtgctgaaatattactttaagataaggaacaggagcgggtttagcgaagctgtccggcggataaaggagtcgtctctggttctggacagcgagcttctcgagtgggtgaggttttacccgtcagacggataaaaccggcggcagaaggccggggcgcacaaagccgcgataccatggcacaggaggtgcaccatggcgctggaattccagggcgtacttgaaaaaacagacagggtggtagatgacaatgatatgggaaaatgtgtggacaatgatagggagcgcgattggatattttttgctgacactggtgcttccctctgtctgcctcagaaaatatactgctcagaaagagctgactttccgttttttcttctaccagtgtatgggaaacttatacctgaactttgtggttatctttcttggatttctgcattttatcaattttgtttctttgctggtcatgttggttattctgccgttatccgttacttgttggagggagcgcagaataatcaccacgtttcggagacgtgcagcgaaaatcctgagagaactgatattagggatctatggattccaggtatttttccgcaagatcaggctgaacctagaaaaatggctgctgaaaaaaaagaggtccctcaagggcagcgcaatagaaatcctgatattctgcgctgtcatggcgtgggtcatctggttttacggatggtataaaatgcataatacaggatatggccatacggacgaagagactcatctttactggattggggcgctgatccacgggaatatgtttccggccggtatgtatccccacggagtgcacaccctgaatgcggcgctaggaatcctattcccgctgaatgttacccgggtttacctgaacttttcggttctttcaaccgtcatggtctttagctcggcatatgcactgttcagaaaagttttttccaatagatatgtggcaatggcgggctgggcattttttgttctgacagatttgttccattccacgtcctattttaggtttcagttttcgtttccaatggagttcggccttgttgcggcctttggcatgatctatgctatgctggcgtacataaaaaagaagcagaagggtgatttgattctgttttcagcctgcatcacgtggacactcatggcccatttttatgtcaccattctctgcctgattatttgtgtttgctttggggtagtatatctgattcccatactgcgcaaaaaagttttgcttcgttacgctgcggcagggatcgtaggtgtcttactggcatgtatcccgtatatatggggttacctgaacggttatgaatttgaacgctctattgaatgggcgctgggaatcacgcagactacagcagaatcagagaaccagaagactgaggggccccgcccggaagatgcgcagaagagtaactggcgggaggagggcgctctttcgtttgcacaggatctgctgaaagatgaatctaaatatctgtcgtacaatttcgtaagcaacagagataccgccaggctgctcatgctggcggatggagcacttgccctgtacgccatgctgggactggttctttcaaaaaagagggtgcgttatttgggatatttgttctgggcggtgctttgggaggtctgtgcaatccttgcatgtgcgtattatctgaacattcctgttttaattgaagtaaagcgaatggcgactttcctgtcatttttgaccatccctctgctggggctgccttttgagatgctgtttaccctgctcaggctgtgcagggtaaaagaaaaatatctggaaatgtcttttgcggttctgatcaccggcggtatctgggccatgtcgtcagcgggaagagtgaaggaagaacgctattacagtattacgatttcggaggcagatatgagggtgtgcctggatctgtgtgaaaatcatgaaaagtatacatggacggtcatatcacctaccaatgatttatctgtaatacgctataccggatatcactatgagattatagatctgataaaagcactggatgaaggaaagaaaaatatctatattccgactccggatatatatgtggtaacggaacgacatcccatctcatttaccaatgaccgtagaaaaattgacaggagtgacatcgatgcaccggataatgtacaggagatcagcccggaactggcgcttcaggatgtggagtgggaccgggataccagtggtctgcatggtgcggatgcgccgtattattttcagcgggatgtggtgatgtctaagctccattattggatggaggcggtaaagaagatttatccgaaccatgtctcggaatattaccaggatgagacggtcactgtctataagattacacaggatccttattttacattaaatttgtcagtggattataagcagctggcagcagatagtatacattaatctgccgctaggctgcagacccgcccgaagggcatgaattacggggtgccctttgggtatacattaatctgcggctttaatgcagaccaggatgcagaataagttacagggggcatagaatgaaaaaaatacttttgatgataccggcgtacaacgaggctgaaaatataggggctcttctaaagcaaatgaaagaggccgggctggagaccagtatggatatcctggtgattgatgactgctcccgggacggcacgtcggaaattgtgaaggagtccgggttcaaggtaatccggcaagtttttaatatggggtatggggctgctctgcagactgcttataaatatgccgtagagaaagattatgattacctgctccagatggatgcggacggacagcacgacctctgcaatgtggaggtgctgtgcgggaaactaggctgcttttcagaggatatggatacatatccggatattgtcattggttcaagattcctggaggggagccagtctttccatatatcacggctaaaaaaatatacaattctttttttcagaaaaatcattaaaaaagtgacaggatgctgtcttaccgatccgaccagcggacttcaggggcttaacagaaaggcattttcgttttacgcttcctataataattttgacttgaagtatccggacctgaacatgattgtgcagatgcttctgctcggcttttgcatcgaagaggtgccggccattatgcatgagcgcaccgcgggagtgtccatgcatacggggctccttaaagtgggaaagtatatgattttgatgatgttaagcacatggaatgcctggtcgcggtataagacagggagcacaaaatgaaattactgaataagtttagcatttcccaaaaaaaccagctgaagaaatatatctttgtttacatagtcctcatactgttttgccttttgctcgttttcctgctggtaggcaacctggataatatatggcggagcattcatgaaaccaacagggtggaaacagacagccgtgccgagtatcaggcggtggtaaaactgtccgagaagctggagaaagagcacattgcgcaagcaaagcaggacactgcggttgaaaagaccgttgtgtggggaacgggcacggcgagttataaagcggttgccctgcagcttaataatatgaaggaggacttccgtactgaagaacagttggaggagtgcgcgggggcggagatcctgtttgtatgcaaaacagattttaatgaccaggagattcagatgctggaggagtacagcagagcgggggccgcgcttttcttcacggaaatcccatccgaggctgcgcttgagaagaagagcgtcaaagatctgctggggattgacacctataaagggatacaggaaaagaaggggatccgccttacagaaaaccttttatttggggagattacagaaagtcgggaatctttcacaatgaagtccgtaacactaaaaagacaggcagaggtatacggttccgcgctgcagagtaaaaaagtaaaaaacgaaaatcttgcgcctgtattctggagatatcagagcagtgcagaaggcgggagcatatacgtggcggacagggagcttatggcgggtaccatggtctatgcagtagtcagtttcctttttacagatttataccaggcctatatgtacccgatagtaaatgcatactgctttgccgtctcggggatgccctatacggatgaattcacctccgagtatctggaaaaagaataccagcgtgatagcatgggagtacaaaatgatattttcttcccggaatttcgacgctgtgaagagaggtacggcgtaaagaccacctggtatacggatgaacgtgaagagatcaaaaaatactcgaatgccatgcttgcgtattatctggatggaattgtggaaggaaacaatgagattggtacgcttaataactacagcctgaaacgggaggtggactccccttttgataaccggcttgtgttatggaattctgattttgaatggacagataagttaacagatagcgtctgtatcccataccgtgcgcttacagagaaaaaatatcaaaacatcatatttcacgataaaggaatctgccggggaatgggattgaacactgtttttacagacatttctccctttttatatgaaacagatgagaagaagcaggaacgctggatcgactactgccggaatctggagacagttctgggggttgaaaaggaagatattccatggctggaacgagtgacagttggtgaggccgtgtacagagtaaaagcatttcaaatgatggagccggagattagatattctgataaacagattgatgcggtgatcggaaactttacgggaaaagcgtacttttacctgtctctgccggcggaccgggaaataaaaggggcagagggcgcctcggttaccagaatcagtgatgtgctgtatctggtagaggctgaaaaagcggatatcaggataacgtatgaggaataacataacaggtactagtacagcattgcactaataattcagcaataagcacctgttcgctacgccatagctgtacctgctttcgctagacgtaggaaacactacgccgtcgcggaagcaggcacaactctgacgcagatatcaggcacttattaccgaaagattaatgcactgctgtactagtactaaaatctgggcagcagggtggtataagaaaggaaagggtttgtatgaaagtatgtttgattgttgaaggagcatacccctatgtcaatggcggggtatcaagctggatgcaggggctgatgcttgccatgccggatgttgagttcgtggtacagtccatagcggcaagcccggatgcgaatctgcagtttaagtaccagattccctccaatgtcagtgagattcaggaggtctatcttcttgacgacgattacgtaaataataaaacacagaaaaaagttgccctaacgggggaagagtacgatgcattcgagaacctgatgtttgaaagcaatccagactgggatgtcattatccggttttttgccgaaaaagaggtgtcgttgaatgcgctgctttcagggaaggacttttttaaaatgacactggattattataatgcaaattttcgcagagttgcattttcggattttctctggaccatgcgttccctgtatcttccgctgtttacgattctaaaatccagaaccgaaaaggcagatctgtaccattccgtgtccagcggatatgccggtatctgggggtgtatgcagaagagcctgtacaaacgtccctttctgatgacggagcatgggctgtataccagggagcgggaggaagagattatcaaagcggactgggtaagcgggatttacaaggatatctggattgggcagtttaaaaagataggggagtgctgttaccagtatgcggataaagtggtttctttgtttgaagatgcccgcagattccagatagagctgggatgtgatgaaaataagacaatggttattccaaacggcgtaaattatcacaaatttgaaggtatccggcagaaagagaatcaggatccatatatcaacgcaggggcagtcctgcgtgttaccccgatcaaggacgtcaagaccatgatcagtgcattcgccctggctaaaaacaaggagccgcggctgaagctatggattatgggcggtatggaggaagcagaggattatgctgaagaatgccgcgccatggtgcgggacatggacattaaggatgtggaatttaccggaattatcgatgtaaaagagtatattggcaggatggattttctaatactgactagtatcagcgaggggcagccgctttccatactggagggcttcgccgccaggaaaccatatattgcaacaaatgtggggaactgtaaggggctgatcgaaggggaacgcgacaattacggccctgcaggatacgtcgtaccggttatgggcgtgtccgaaatcgcccgtgcgatactgaaacttgcggaggatgaaaagaccagaaaaaggatggggcaggcaggttatcagagagccgtaaaggcgtacgatgaatcggtggttttcggcacatattacaatctttatcagaaattgacaggaagcggggaggtgtgagcatggcaggcatcggatttgaattaaaaaaaatatacagaaaagaaagcatatccaggggaatgctgggcgttgtctacagctcccttgtgacgattggacctatgatactggtgattgtggcaatccttctgctctatttctttttagggatgacaaaggtgccctatgcggacagagagctgctgtcctccacgattctttacacctttatcttttccgtcatacttacctcaccgttcaatgtaatcttttcccggtatctggcggataagttttacacagaggagtattccaacatactggcatcctattacatgggaaattctatatgctgtatcattgcgacactgctgttccttccggtgggatggagtctaagggtacggggggagatagacctgccatttattattgcggcctatattcaatggatttccctggtcattttattctttgcagttacatatctgcatgcgaccaaggattataagattatcgcgctttttttcgtaatcggtatggcggtcagctttctggtgtcgtttgccttttataaagtggctgggcaggatgcaatccattctattatatacgggctttccctgggattctttttgattgcggtctgcgacttttcctatataaagaggtatttcaaaagcgtgtctaacgaatatggggagtgtatgcactatttatggtcgtttaaacggcttttaggtgctaattttttatatattctgggactgtatgttcataactttgtattctggacggtaccggggcgtctctttgtggcctccacgtactacagccaccaggcatatgatatggcctcatgccttgctatgtttacaaacatttctgttatggtatcctttatggttgtggtggagacacggttccacacggcctataaggaatacatggagggtgtcataggaggaacttataaaatgatagtaaaggggagaaagaagctgtttcggacgctttcccagcagatcatccaggtatttggcacgcagattgcaattacatcggttgtatttctgtttatggtattgtttggcaagaaaatagggtttgacagtgttaccatgaccatctatccgatgcttgtggttgcttttctgggaatctttatgatgtacggaaatatcatctacctgtattactttgcggacatgaccggggcgtttctgaccggggcgcttttctttgcggccactctgacctgcagcctgttttctagtaaatggccgattcccttttggggtgcgggagtatttatcggaatgcttgtgggctggacatacagcttttttagaatacgctggatcgaaagaaatctggataccttcatattctgcgattacaaagtcgtggatacgatgaagtcttctaataaaggaaaagttgtttaccgaaagaaggagcgcaatgcagcaggatagtggaaaaaggctgctgcaatggaatatcattgtcagtatgctaagccaggttttgtctctggtgattaatcttatttcaaagcgggtgatatgcctgtacctgaatgtggagtacctgggcctccagagcctgtactccaatttctgtgacgtactgtcctttgcatattttggcgcggggacggcgatgctgtttagtttttacggtcctctggccagaggagataaggagaggctggctgccatttaccgtcactatgatggcatttataaaaaaatgacctgtgtagtcctcggaatcggttctatatccaccatatttgcggtgttctcggtcaatgccagtatcagcgatttagaagtggctgtcacgtacctgacatttatgctgtccgtcgttctatataacaggcagatggtgaggaattactttatccaggcggaccagcgcagatattttgtggcagcggtgaccggaggggtggatgcctctgcccttattatcgagatcctgcttctaaagtacttcaaaagctatgaggcatttgtagtctgcatactggttaaaaatatactgataaacgggattttcggtaaatatctgaagatccgctatgggtatctatttaaaagggggagcaggctggaaaaagaagaggcggatacgatcaaaagcaatgtttccgatatggtgatgtaccgatttggaaaggttctgatcagcaatacggataatatctttatctcccgcttcatcagtactgctatggttggaatttattcgaattatcagtttattatcgcaggaattacaagcctgattgccgctttctacgaggctattacggcaagagtgggccagatgctgtccatgagcgaaagagaaaaccaatatcagggctttcagttctattcgtttatcaattcctggatggcgggagccacgattgtctgtttttattatctggttcaggattttatcaggatctggatggggtcggtggacctgctttcccgggaagtgattattgtgatcattgtaaactattacctggaaatatgcagatctgccaccaagatgtaccgggaaagcgccgggctgtttaaaaatattaaacgcatgatattgatcaagggcggactgaatatcgttctttcctttgtactgggaaaaatatgggggctgtggggaattttaattgcaacgactattgcatcggctgccacgcttttctggtacgaacccctcattgtattccggtattttaaaaaaagctttatgaacgaaatctattatcagttcatcacgcttctgcagatggcggcatccttccttgttacagggctggccgtcggggcgcttccggaaggcggagtcctgcacttcctcttgaaagccgctgtgtgcggggtggtatgcaatctttgctatctggtattctactttatctttaaacagagtatgaaaaagtatagcaaaccataggcaaaaccggtttgtgccgtgaagtattgccgaagaaggaaatggtatctggaagaggaggcattatggagatcagctttattatccccgtatataatggggaacagtttatacgccgttgtatttgtgaaatccgcagatgggagtgggaggagcagatagagattctgatcattgatgacgggtctacggactgcacggggataatctgtgatgaggaggccgctgcagataaacgggtcaaagtgtttcatattgagaactgtggacagggactggccagaaattatgggctcagggcggcagcggggaagtatatctgttttgcggatgcagatgacagggtggacaccaggaacatctaccgattgtgggaacaggcaaaatccgtccacgcggatgtcgccatgggcggttattacaggacagacgaccgaacagaggagtgggtgcacgtgcccggagaaggcctgatgaaacggcggggaacagacgcagaaatggggctgtaccataaggtgaagacgcagagcatgttcggctatgtgtggaataaattataccggcggcagtttctgcgggagcaggatatatggatggatgacatccggaccatgaatatggaagattttatgtttaacatgaaggtgtggagccgcaatccggtgttttactgtatggactgtccgatctgctattacataacggctcatgcgtcaacgacccgcagaccagatccacaggttcatacgaaaagcgtcaatatgatccgtacgcttgttggttatctcgatggggagggcgttctggaagagaacctggatatggtggttccggtgattatgaggtctttctgctggtcaatgataaaaaacatcccatatgaagggatgtctatgagacgccttgaggagcgggctgggacgtttgcttatgccccggaggtcgaaaaggcgctcggcgctgtggatgcatcaaaacatttaaaatcccttgtctcggcgccgcagaggtggttctatcgtttctgcatgtgtgcgctgaagcggaaaatgattaaaagcatcagccgcatattttatatatgctatccgctgatgaaacgatatgcatcggcagttctaaagtagaggagcgaaagatatgataagtgtaattgtccctgtttacagggtggagcagtatctggatgcatgcattgaatccatactgggccaaacatttcaggactttgagctgatcctggtagatgacggctccccggataactgcggggagatctgcgacaggtatgccgggcaagacgccagaatccgcgccgtgcaccaggaaaatcgtgggctgtccggggccagaaatacaggaaccggcctggcagaaggggagtatattacatacatcgacagcgatgacaggatcgggccagaatatttggaggtactgtacaataatgccgtagaataccgggcacaggtatctgtctgcgggtactgcctggtatgggaacacgaaagtgggcagagcagaaatgggcagaacaaaaagaagggggaacaggactttcataccctggtttataccggcaggcaggctgccgagaagatcgtgaaagaaagcacgcgtgcgatgattactgcctggggaaaactttatcacagagacctgaagccgctgctggtatatccggaaggaaagactcacgaagatgagtttgtgacgtaccgcgttttttatgcagccagacgggtcgctgtatcaaaccgcccgctgtaccattatctgcagcgcagcgggagcatcatgaatgacggcttccgggaaaagcgcctggataagatcagggcgctgcgggaggctgttacatttttccgggagaacaatgaccgggagctggaacggtatgcgaggaaacggtatctgaccaatttgcagatcgcatggtaccggaccgcgaagtttctgccggatcgaaaagagctgagcgggctgctgcgggcgcaatggaagttgacttacggtatatataggaaagagatcctggaatgcgggggatttatggagcggttgtcgatccgcatattttccgtttcaccgcgggtatacagggtgatggcggaggtatatctgaaattatttccggaggtttgagacgattaaaaaagatagaaaaatccaaaaagcactacgatttatgattcttatagttctattggcggttgcggttatctgggcggtatctgagtaccggggcaggcttgcttttacttacagggagagtggcagcagggtggcaaatccctttcagggagtctatttccagtgctccgccggggatactgacaggctctatgatatggcggaggaacacccggactatgatgtagttctgcttacctatcttttggatgacgagagggagatggatgtgataccagaggataaggtacaggatctggaaaatgcactgagcattgccagggaactggggctttcagttatattccgggcagcatatgatttccagggggagtatgaggatccggattttgatatcatgctaaagcacatccgtcagacagggaaggttctgaatgcttataaagactgtatcgcgggagtccaggccggtatgatcggtgcgtttggagaatggacccagagccggtacatggatacaaaaaggtaccgtatggaggtcatacgtgcttgggagagcgtgctggatgaaagaattcccgtgtctgtaagaaggcagaagtttatacgggaggctgaagcatgggggtgcgataccgacaggctgggggtctataatgacgggttgttttccagcgaaagcgatctgggtacctacagggaagattacacaagagaagaggatctgaggtggtccgctgcgaacattaaggtgccgtttaacggaggagagatgccctttatcagtgaattcaccgatatacacaatgtggcggaagaagcgcagcagctgaatctgtcgtacctgcatgcggagtacaatcatgaggtgtggcagtactgggcggggcaggaatatgacaatatgccgggggatgaatacattaaaatgtatctgggctgcaggccgtgggcagaatcgtttagtatcgacaggcattttacggcaaaaaagcagttacggctggagctggagataagaaacagcggcttttccatgatcaatccgaactaccggtggtattttattctgcggtgcggagaagcggaaaagcggataagggccgattcagaaatggaatcaaaggaaaaggggacagtcagcgccgaattagcgaatccctttccgcgggaagagctggagaaaaacggaatgactgtgggaatccaaatctcaaaagaagagccgcgggatatagttgaagcttactgtgtccggctggcaaacgacaaaatgggatatgaaaacggaattaatattttagcaaatatcaatcagtgaggacagagggtaaatgaaaaagcagcgtaaaccgtgctggctggaaaaggcatattgggtggcatgtgaaaagatcctgggtttcctggcattgctgccggccagggatcataaaatcgtgtttgataattttggaggaaggggatacggctgcgatccgaagtatatagcagaggagctgttaaagcgggacgaggatctggatctcgtatggctgacccgtggtatgccggaagaatttccaaaaggtatccgtccggtccggtacggcggaatcagggcggtgtatgagcaggcgacggcgcgggtgtgggtggataactttaagagcggtatccgcatacggaaaaagaaggagcagtattatattcagacatggcattcttccctgggactgaaaaagaatgaacaggatgccgtgcagctggaccgggcttatgtaagaaaggccatgcgggatgcatccatgacggatctgatgtattctaataacgctttccgggcggataaatacagaaatagcttctggtatcatggagaagtgatgcggtgcggacatcccagaaacggtgttctgctccatacgccccccgcggtaatccggaaggtacgggaatattttgggataccggaagagaaaaagatccttctctatgcacctactttccggtcgaaaacgggaagcgcagggtaccggctggatatcggcgcctgcctggaagctctgcgggacagattcggaggggattatatctgccttttcagaatgcatcccaatgtggcatatcagggtacggaatgctcggagggaataatccccgcctctgattatccggatatgcaggagcttatggctgccgcggatgtcatgattacggactattccgggagtatgtttgagtttatgctgacgggaaggccggtatttctttttgcgggggatattgcccggtatctggctgatgagcgggaattgtactttaccttcgaagagctgcccttttccctggcagagaataaaacgcagctgcgtcaaaatattctggagtttgattgtgaggaatataaagcagcgtgcatgcagtttatggagcttgtcgggatggaggaggacggagaaggggccagggtgctggcggaccggatcttagtgaccagtcaggagataggtaagtcttttgtttcaggagataggtaagtcgattcaacaggtggtaagtcgaattgttaattagtatcagtttaaaacatccattgccgttatacaagcggtttttgtatcaagcattccaagtggaaagtcgtgaagccaaatgatatatgttttatcaccgtttggctgcactcctacctgtaagcctcgaagtgataaacttacagaatacagtgttttgttgatttttacttctccatgtttgttaatctttcttggcaggtaaccaatcggatattccagttctgctaacgcttcttcgtatagcagggtagattttttataaaaatcggagggggtactcatttgtaaggcttcatgtgggcggatgttgttgtattcttccacccacaaatcaatggcggcttgattggcctctctgccaccaggtatttttccttgaatctccctgcttatatctgcatgcatgcgttcgtgggcaccattttgcgttggacagcctggatcggtacgatccggaagaatgccaagagacatccaccatgcgcttaaggttgtcaaaccaaggaagccatttgaggaagcaaaaggagtaccattatcactgcgaatgattttgggaagtccgtagtgatagaataattcttcaaatacagctttgacagcatccgcagttgttctctccatcaggcggatggtaagaatgtatcggctgtgcagatcacggacggtcagtggaacacagcgttccccctgggacatccaccagcctttaaaatcaacggtccagacatcattgggttgaagagcttccaacttattacgcagtttggaagcagttggatcgggatgccgaaagcgtcgtttgggaatcaacccagcttttcccaaaatgcgataaatactactctcagatggtgttggcgactctggataagcgctcttgtaaagaacggccagtttcttaggcccccaggccggatgagcggaacgcattttaattaaacgaatgacggtatcttcatccagctgattcggagaattagaaggggccttgctctgatccgcgaggccggagaagccaaattccagaaagcggtttttccacttatgtccagttttttctgcgattccgaacttttgacagagagccttaaagctatcagttccacatagatattctgtaataaattgtttacgttgttccataacagaggtctccttccatggcatacagaaacaccttctttcgttggttatttctgtatagtttaacatttggacttacctatgtcctgaaactttttacttacctatgtcctgaaactggacatagaagagatacataaaaggcagacggattgctgatccgcctgcgaacccctattttattgatatccgggtctggatttctggagttgctttatttcagttacagaaaccagccggatgattccgaatccgacagcaaaagtgaggatgcagaaaagcatttccgacccggaaggaataccggggaagagttccacaatggaaccgagaacaaatcccagaattataagatatgccggctgggggtattttgtcatggcgtgttccaggagctttgtggtaaggacaattcccaagagcaggccgatgccaagtggcgcaaggaatgtcagccggaaactgctaatcgcccccataacggaatcgtatatccccatcaggaggaacagataggagacgctgattcccggcagcaccagtgcgattgctgcgacaaatccagctaataccagaagcagcaggccgcccgccccagtagtcatatcagcctgtaaggcaccggagggaagcagggagaacagcagaaccacagacagcccgatgcccatgtacaacggatatttccaggagaagcgccgtatgtctgcctgcttaagcgttaagggtacactgcccgttactgcacccataaagaagtacagcgtaggcatgggataattttggatcagcccgagcagcggacgggcaaagagaaccataccgaatccgccgcctgcagaaaaggctgtaaggaagagaaggttttcttttttatgttttgtaaaggaacttacggaatggatcagtttggtgtaaatgccgagtatcatagccatggaaccgccgcttacacccggtaccagcatggttccgcctacgatcattcctttgattgctgtcagtaagttagtgtgtttcatttggtctcctttttgcgctttattatatgtgcagagggggcgggatacaatgggggcaggggaattttagcgggtttttagcagatgggggaggtgcgcggaggtactatgttatgcggagcaagatgcccgccttggcgtacttgaaaaaagcagatctttgtgcataaacaaaagaggctgcccttttcacggccagtagtggcctgaaaggacagcttctttatcttagagggacccgtctgggtttacgtagaaaacaatattatagtaattccggagttataaaaggaatatcagtcatactatcatggatttcataaaaatagaagaggatatcactgcagtactgccacagaattagtattgcgcttctctttcatattattcatgtaatgtggtgtaaatagtgaaaatgaataaatagtttatcattattcgaagatcagttactaaactgtgaaaacagaactaggttaaaagaactaaataacttgttatattatactattttggttcgggtttgtcaataagatcagcgattgtatgtcaactctgtgtaaacttacctttggcctgcacaggacatatgtatttgaatatctgcttgtcctgacaattcgtattacttttgagatgtacataaaaagagctgttccgaaccttttggtacggagcagccttttttctgctatcttatattgaattctttgctcttttaatctagtccactctttcaataccaagggtgtctttaaacaccctaatcgaaagtttgttggaagtaaacaggcagattatcagtattactgtaagaacggcgtataggaactatgaaatccggtaacttcaagcctgcaaacgaacttccagtttacagtattttggccgtatgataaaatgtaataagggtgtggtgcgggctgtcctgcaccatatgagtttgtacgattgatgctgtatttggaaaccaacaataccttattgaaccaaaggggaacaattacattatgcagatgcgttttgaagtcccggacaccttttggagtttattccgctcggtgaaccgggatgcttatattgaggcgttattatatattaatgaagaataccagtacaataattattttttgacgcgggaagcctgcattcaggtcctgggcgacatgaacgcgaggaagcgtttcgagctgcagcgcgaggaggatgagacggagtttgatatgttggaaacgccttcctcccgtatcctaaactggctgcttaggaccggctggctgaagaagattgaggattataatacgctggctacgaatattgtgataccggattattctgctgtttttattgatgcttttgagcggctgacctcggaagacatggaggagacggaagtttatatccagaatgtgtatgccacgctgttttcttttcagcatgatccgcgcgtgaatctgaatatgctccggacggcgctgatcaatacgagaaagctcaataaggcgctgcaggacatgcttcataatatggaccgtttctttgcgaggcttctggaccagaagacttacggggaactgttgaaggagcacctggaagggtatgtggaggagattgtgcagaagaagtaccatattctaaagacttcggacaacttctacatttataagatggatattaaaaaggttcttcgggatatgcgggaggatgaggagtggattgagaagatcagggagcgttccaaggcccagggagatacgaaggaggatgtgttggacctgctggatatgattgagcggggattcgatgatattgagcacaggatcgccaatatggataaggaacacacgaagtatgtccgggccacggtgacgaggctgaattatctgctcagtggggagacggacacgaaggggctggtgatccggctgctgaaccgcatggcgcagggagacgattatgaggaggttctgcggagtacgggaagccggatgaacctgtccctgctggaaatgatttctgaaaagtcgctgtacaagcgccggagggggaggcaggactttatcagccagatggcgccggaggaggctgccgaggatctggagagaagtgatgtgctgaggctcaaccggatacaggccagatacagcagaaggcagattgaggagtttatcgaggcgcatatgaaggacgagatgctggatgtgtcaaagatggagatttcaggggaaggggattttgaaaagctgatactggcttatgatatgagtaccaggaaggacagcaggtatatggtgctggaggaagatgcagcgatggtggagaataatgggtaccgttatccggggctgaggtttgtacggcggcggtgagacgggcagcttaacagaatctcaaaggagcctcaaaggggtcagacccctttgcaggatgaatagcatcagaaaagtgaggagcagtgtttctatgatagagtattatgaacagctgatgcaggaggagcaggaggcgctgacggatgtgattcagcttctgtacaggcagacgtttcttctggagcggaagtatgacaggcgggcgggaaggctggcctatgtgaaggagtaccggatatgcagtaagcatttggaatttttgagagcatattttcaggtggcggggattacgcttcaggagaatgcccatatggggctgatctatatccaaggggaggcgctctggggagaaaagatgcccaggcttgccacgatatacctactggtgctgaagcttctttatgatgagcagatggcggaggtttcttccagcagccatatcgtgacgactatgggggcgctcaacggaaaggccggggacttccgtgttcttaaggggattccgtcgcccacggagatgcgaaggacgatctcccttctgaagaaatatcagattattgagccgctggatatgctggaggaactgaacgaacataccaggctgattatttatccgtgtatcaatgcggtgctgatgggagaggatatccgggaactgctgaaaacatttcacgaggaggacaacattggagacgaaacagccattcaaagcactatcaaagatatgcctgaataactggcattatatagacaggaagatactgactctgaatgaggggatcaattttttcaccggccattccggcagcgggaagtctacagtgatcgacgccttgcagattgtgctgtatgccaatacggacgggaggcgattttttaataaggctgcagcggatgattcggaccggacgttgattgagtacctccgtggcatggtgaatatcagtgaaaataatgaatcccaatatctgcggaaccataatttttccagtacgattgtgttagaactggagcagaccaatacccatgaaaagcaatgtgtgggtgttgtttttgatgtggagactgcgacgaatgagatcggcaggctgtttttctggcacacgggcgggcttctggagaatggttaccgggcggataagcgctgcctgacaactggggaaatacgggagtatctgcagcgggtatttcctccggagcagcattactgcggccccagcaatgagcgtttccgcagacagctgtatgatatatacttaggcgggctggatatggaaaagttcccccggctttttaaacgggcgataccgttccgcatgaatattaagctggaagattttgtgaaggaatatatctgcatggagcaggatatccacatcgaggatcttcaggagagtgtcatgcagtacgggcggatgcgcaataagatagaggagacgctggaggagatccgaagactgaaggagatccgggaaagttatggacagtacagggagcgccgcagggacgccgagtcctgtacgtatcagatcgataagctggagatgcttcagctgcgggcgaagattcaggagctgtcggacaagattgggggccgcgaggaggagatcagccggcaggagacgatgcagaggcggcgggaggaagatgccgcccggattcagaaggaatatgaggacgtgctgcttcggatcagcaacagtggctattccgggctggaaacggagctgctgagtgtgaatgaggcgctggagcgcctgggcagcagtaaggtaaagtgggagcagactgcggtgcggttgagggactggtccggctgtgacgcggcgcccaaccaggttttatgggatatcgagaaatttgggaaggggaatattaccgaaggggagctggaacggctgaaggagagcctggccgcgcttcgggaggagctggaggaggagcggcgtgagaccgactcccggcttaggaagattaagaaggaagagcatgaggcacgggaggagctaaaggaactcaggcaagggcgcaaggcatacccgaaggagcttgaggaggccagatatgagctgcgcaaccggctgcatgagcgctgcgggaagtttgtgaatgtacagattctggccgatctgctggatattcgggatgagcggtggcacaatgccgtggaaggatatctggggaataataagctgcttctggtggtggagccgcagtatgcaaaggctgccatggatatttaccaggaattggataagaaaaagttcttccgcgctgcagtgctggatacggagaaggttctggaggaggaacatccggtacggcccggagcgctggccggtgaggtgattgcgcgggaggcgcatgtgaaggcatatattgactttttcctcgggaatgtgatgaaatgtgagagtgtggaggagctgcgcaggtgccgcgtgggtgtgacgccggactgtgttttgtaccacagctaccggctgcagcacatgaatccggagaactacaccagaagagcttacatcggggaaacgagtatgcggcagcgcatccgccagctggatgagaagtgccgggcgctgcaggaggagcggatgcctctgcaggagatgctggagcaattccgtaagatcgggcagtatgaggggctgctgcagccggtttccgaatacatggaatggctggatgatgtggggaagataccggggaaggagcggcaaaagaagcagctgacggagaagatgcgtacgctccgggaagaatctgtgtctgcgtgggagggcgagaagcttgagctgatgcggcggcaggaagaaaagaagatgcagatccggacggcccaggaggagatatggaagaataaggagtttattagtaaatgtaagtccgatagcctggagatgcatgctcagcttgcggaccgggagcggtacttcaaagaggatgcggagtttgaggagctgtttgctcagtttatggagggcaggcgtaccgtgaattacgactatctcaggaggcagcggctgggggaccgggcgccgctggaggagaagaaggaacgggcttaccaggagctggtggatatccggagcagctatacacagagatacccgaaccggacattctcagccagtattaaggacaacgtcccttacgacaggctgctggagagcttggaatgcgacgacctggaagggtacaaagaagcggccagggagcaggcgcggtcggcggtagaacatttcaaagacgactttatcttcaagatccgcagtgcaatccgggaagcttaccagcgcaaggatgagctgaaccgcattatcagcaggctggatttcggaaaggacaagtaccagttcgtgattacaaagaacaagggaccggacggaaaatactacagaatgttcatggatgattcgctgaagatcaatccgtcccagctgagtcaagccatggagaaccagctgaatatgttcaccatggagcacgaggatcagtacggggagatgatgaacgagttgatcaacatcttcattccgcccgagaatgccacaagagaggagctggaagaggccaagaagaacatggacaaatatgccgattacaggacctacctgtcctttgatatgcagcagatcgtgcagggcgagaaagacatgaccatcggactcagtaagatgatcaagaaaaactccggcggcgaggggcagaatcctttgtatgtggcactgctcgccagtttcgcccaggtatatcggatcaacctgtcgcccaagatacatcggaatcccaccattcggctggtggtgctggacgaggcattttcaaagatggatgcggagaaagtggcaagctgcatctcgcttattcgtgggttagggttccaggctataatcagcgctacgaatgataagatacagaactacctggagaatgtggataagacatttgtatatgcgaatccgaataaaaaacatatatctatacaggaattcgagcggacagaatttggggaactggtggaggcagaataggggtcagacccctttgcggaccattctcagaatgttcagttaattggataacaaagatgtgtttttcccctagggaggcgtgatattgtgtatcttgtagaaagaattattgagaaatgtgagaacagtcaaaatgactggcggctgggggccacaggcgggaagtctttgcggattgaccagcaggaatatgatgcctgcgggaagactgctctggtctcggaggcggaggagctggagcgggcggggatgatccggattaagtggctgacccggggaagtgatatcgagcggatttactaccggctggaggatctggacagattttatgcggctctgatggaaacacagcccgggcggcagccgaaatggaaacagatccaggcgtactgcgaactgttggagcgggaactggacgggctgcagacggagtggatctgccggtactaccgggaccttctggagcagctggggcgggggaatattccgaagatgctggacaaacgggaagtatacctgccctgtttccggggaatcgatgagctgaaagagaccgtgtttaaacggatcttcagcagtagatatcttatgaattcgaagacttttgaggaaaacgcggaatcccatatcatagcaaaggcccggcagtattgcggagatgtagtggaagagatggatgataaggaagtactctcccagctcaatattgaggagtattcccaggaaatgtctctaaagggggctctgcggattgggatagtgcagggctcaacatgttttgatattaacctgggagaatatatatatgggacggtcttgaatagcgagacattgaaaaatgccatgatcctgagtgagcagccggagataaaatgcgtagttaccattgaaaataaggccaatttcgtatcggctccatatcaggaaggaaccttatatgtcttcagccacgggtatttttcaccacgggaaaaaagatttctgcagcagctttgggcggcgctggagggaaaaggcgtacagttttatcacagcggggatttggattacggtggagttaagatttttgagtatattaagaaaaatattttcccggatgtgcggccgcttatgatggacgcggagacatatgaacgctatctggcatggggagaaccgattgccgcaaagacgctgcagaagctgaaaaacactaagataccggaactccagggcctgatagatgctatcctggagaagagggcggctatcgagcaggaatgttttctgatgtgaggcctgcgtggaaaaacgcaggcgaaaagggggaatgtttaggcagtgcgctgtgcacaaagagtttccgagagtactcaaaattaaaaaggaggtaagtatgaaatatgaaataaaaggcggggcatttcccgtggttgtatgtgagcttgaaaatggggaacagatgattactgaaaaaggctccatggtatggatgagtccaaatatgcagatggatactgcaggcggaggtctggggaaaatgttctcaaaagcattttccggcgaaagtatgttccaaaatatatatactgcacagggggcagggatgatcgcgttcggttccagtttcccggggaggatacttccgcttgagattagtccgggcagagagatgattgttcagaaaagtgcatttcttgcatcagaggcaggaattcagctgtccatgcattttaataagaaaatgggagcgggatttttcggcggggaaggttttatcatgcagcggctttcaggttcaggcatggcatttgtagagatagacggggaactggttgaataccagctggggcccggacagcagatcgttgtggataccggcaatgtagcgggatttgaagtcggcgtgcagattgatatacagcaggttccggggatcaagaataagctgttgggcggtgaagggctgtttaacaccgtactgacgggcccgggcagaatctggctgcagacgatgccgatatccagcgtggcagcatccatccggcctttcataccaagcggaaatgcataaagtgcgcaaaggggtcagacccctttacaggtaaggagaggagctgcagagatgagattgatgattgcatcggatattcacggatctgccttttactgcaggcagatgctggaggcatacgaaagagaaagggcggacaggctgctttttttgggagatatcctgtatcatgggccgcgcaatgacctgccgaaggagtacgctcccaagcaggtgattgcattgctgaaccctatgaaggaacacctgctctgcgtcaggggaaactgtgatacagaggtcgatcagatggtgctggagtttccggttatggcggaatactgcctgctggaactggatggccagaccattttcgccacgcatgggcacaattttaatccagaacatctgccggcgcttaaagcaggcgatattctgctgaatggacatacccacgttcctgcctgtgaggagcatgaaacatatatttatatgaatccgggctctgtttctattccaaaggaggattcagtgcatagttatatgatatatgaaaataaattatttcaatggaaagatatgaatggagaggtataccggatatggaagacaaatatgcattgctaattgacgcggataatgtttccgcaaaatatataaagccgatactggatgaattgtccaagtatggaaacgtaacttataagagaatctacggagactggaccagcacgtataattcaagctggaaagaggaactgctccagaattccattactccgatccagcagttcagttacacgcatgggaaaaatgcaaccgattctgccatgattatagatgcaatggatatgctgtatacaagtgagttagaagggttctgcctggtatccagtgacagcgactttacaaagctggccagccgtctcagagagagcggcaagactgtcatagggatgggggaagataaaacgccggcgccctttagaaaagcctgtgatatctttaccgtactggaattgctgctggaagataacaccatagaaaaggaagagaagaatacagtacatgccaccggaaaagactgtaagaagagcagtacggatgtggtatccaagaatcagatagaagaggcggtcgtcaagatcataaccgaaaatcagaacaatgataaggagaccggccttggtgaggttggcagccgtctggtcaaactgtatccggattttgatgtccggcgttacgggtatagcctgctgtcaaagtttctggagacatttccaaaactaaagctgaaacaggacggcacacaggttaccgtcatgctgtatgaagacaaaagcaggcaggagatgctggaagagtatattatcatgcttgttcagaatgccggggcccagggcgtatccttaggcacgctggggaacagaatcagaaaccggtttggcgatttcaaagtcagagattatgggtattcccagtttaaacagtatattcagagcttccctagtatacagattcgggatgatggggaacagaactgggcagtacatgttgataacaggtaaatgagtgcaaaggggtcagacccttttgcagaggggtcagacccctttgcggaagggtcaggccccttttatcagttctctttcgaaaattatctttctaaaatgttcgtttccgaataaatttccccaaaaacccatccgcgcccaattgatttgcttaccctctatgctaagataatcttgtaaaggtaacaactcattttataatcaataacagaaaggagcaaagttatgagcataaataagaaacttctcccgccgggccttaccagggaaaacagaacagagaaactaaatcaagccatgagaagtgtaaaaccggagatctgtatcgagcgggcccgccttattacgcagagttaccgcagtacagaaggaatgccttacattatccgcagggctataggcctgaaagaccttcttgagcatatgacaatctttatagaggacgaagagctgatcgtgggaaatcatggttccaaaccccgttgtgccccgctcttcccggaattcggaggtttcagcaaggaagaactggacaggatgcccaccaggaaggtagacacactgcagattacggaggcggataaggcggctcttttgacagaaatatacccgtactgggaaaacaagtccataggagatttatccaggcactacattgacgagcggatcatgcaggtgctagactccccctaccgtgtattcaatcctttaagccgcgcgcgcagcggatatggccattacctgccggatattcagaaaatcatcagccatgggttccgaaaagtagaggaggaagcaaaagattgcttggaaagtctggacattctggatcctgagtttacagataagactcatttctataaagcagtcctgattgtatgccaagggataagacgcttccagaaccgttatgcagacctggcggaacagatggcagcagaggaaggtaataagcgtagaaaacaagagttgcttctcatcgcctccaactgcaggcaggttccttatgagccggcgcggacgtattatgaggcgctccagtcgtattggtttacgcttctgattgattactgcggccaaaatggctccgctatatcaggaggccgggtggatcagatgttctatccttactataaaaatgacctggaaaatggcaccatggtcaaagaagaggcgcgggagcttctggaggcattgtgggtaaagagcagcgatgtcattaaagcaggaacctacatgagtgccagaaataacggcggattcgccactacgatcaacgtggtgctgggcggtgttgatgagaatggggaaaatgcagtcaacgattttacctatgtctgcctggatgcagaacagacggtattcaattctgaacccaacaccagcatccgtatttcacagaagaatccggataaattcttaaaccgtgtactgcagatcctcgtggaaaatgaaggcggaaagcttccattttttaacgatgacttaatcatagacggcctgatgaaggacggagtatccctggaggatgccagaaactacgcaatcgtagggtgtgtggaaccgacaggacagggcaataccatgggcagaaccaatgcatgttacttcaaccttgccaaatgcctggagcttgcgttatttaacggggtatgccagatgtcgggagaacagctggggccggtaaccggaaaatttgaagagtttgagacttttgaagagtttaagaaagcatatgagatacaagtaaattattttgttgacatgatgatcagttcgctcaattccatcgaactgctgcacgcacggtatgggcagcatatttattgttccatgctgctggaaggctgcctggaaaaaggcagagactgtacgcagggaggggcaaaatacgactatgcaggcgtgcagggagtcggaattgcggatgtgggagattctctcatggctataaaaacgctgatatttgacaaaaaggaaatggcgccgtccctgcttctggatgcattaaggcataattttgaggggcaggaaatccttaaataccgtctcatcaaccagataccgaaatacggaaacgacatccccgaagcagacgagttgacagcgtatgtgggaaaacagtactgtgaaagcgtcaaaggccatcggtctccctacggcgcgatctaccgtcccggcctgttctgcctctcctcaaacacaccgctgggccgccaggtctgcgcacttccaagcggcagagaggcggggactccactgggagacggcggcatttctccgaaacacggcatggatatctgcgggccgaccgccgcggtcaagtctgtagccagagtggatcacgagagcgcgatcaacggagtgaactttaacatgaaattcatgcctacgatcctcaggacaaaagaagaaaggcaaaaactcatcgacctgatccggacgtatttcgccatgggaggcatgcatattcagttcaacatcctgaccccggaaaagctcaaagatgcgcagcagaatcccgaccgccacagaaatctcgttgtacgcgtagcaggatacagtgcatttttcgtggaactggacaaagacatacaggatgaaatcatcagcagaaccatgcagtgcgtatagagggaggaaaagaatgcagggaaatatatttgatattcaaagatacagtatccacgatggcccggggatccgcacggtggtctttttaaagggctgcccgctgcgctgcaggtggtgttctaatccggagtcctggcaggcgcatccgcagttattctatgcatcctccagatgtattggctgcctgaactgcgtaaatcactgcccggacgggcaaattacggcggaaaatggactgcagattcattgggacaggtgcgggaacgatcatctggactgggtggcaaagtgccctgcaaaggctcttaccgtaaagggaaaatggatgccgccgaaagaggtgtttgaagaagttttaaaagacgaggcattttataaaagaagtaaaggggggattaccctgtcagggggtgagccgctgctgcaggcagactttgcagagtccctgttaaaactatgccgaggccacgggattcatacggccgtagagacgaccggatgcgtgccaaaagaaaacctggaaaaagtgctgccctacacggatttatttctatacgacatcaaatccgcagacagccaggtccacaaaacctggacaggtgcagacaatcaacaaattctacggaatctggagtggcttgcaagacaaacaaaaggcattttcatcaggacacccatgataccgggagtaaacgatagtgaacaggatattttagacatcatcgagatcattcagaaaaatggaatccgttattatgacatcctccccttccaccagtatggaagcggaaaatacatttcctgcgggttggattactccatgcaggatgtaaagccccatgaggaagagtatgtagaaaaaatcagggataccatacacagcttcggactttccaccaaaatggaagaaatggctgactaagaacaaaatgggcaagaccactttggcgccgccgcgctgcccgccttgcggctatataccttatcacggcgtgcgcatccccggaggagtcttatgatataggaaaaacatcccccatatacctgatcaaatccagatatatgggggatatgtatgatcctagccgttgccgcagagcggtatgtgtatcggacaggacagtgcagacgaaaaaatattatgacagcgttacctgccggcggatgtcaatcgggcttttgctggcggatgtattgcggtacagttccagctggaatacgcacttatcggcccgggtgatagaggtggtaaattcgaatacaaatcccgaatccagataagagatacgctgaatcttatagccggggacctttgctgcacatttcagcagatcagcctcatccttattgataatgattgcttcaattgtctccgttgcacggtagagattcagtgcgtagcgctcactcagcaccttgtacaaggatacggttgaaaaatcaaagaattcaatccgttcgcagagataataggggacaaaagccttctcaaataagattggctcattgttcgcacagcgcagccggtaaagtttaaataccttattctgcgtcggcggcagtttgagctggtcgcggatatactgatccgcctctaccacctcgctcttaatgacaacagaggtgggaaccgctccaagttccctcatattctcggtaaaattgtaaagatagttgatgtttcgtttcatcttgggatctgcaataaaggaaccccgtcctctgtagcggacaaggaggccctcatccacaagcctgtccatgcactggcggactgtagtccggctgatatttaatatgctgcaaaggtttgtctctgtgatcatttgatcaccgggcttcaggacacctgcctggatttgtatcttaatataggaggcaagctgctcatacagaggagaatcgctctcaggcgagaactgaaatgtttctttaaaatagtcaatgtccaattgtatagttcctttctataaaataagaatttccgcccgggttagattgggaaaatgcagtaattatagcggattctgctgttttattttcttcaatagtatcataaatatatacgatattcaaacataattaccagttaatggaatggtaaaaacaactggattatgtctatcggatgtgatacaataataatgtatcaaatgtatgatacatttatattatcatattaaattataaaacgcaatatccacggaaaaagaagttgttgtatggttactatcgcggcccatttgccgtgaatagtaacgttgtatgggggctgataaggattgatgcatacacaggatcgcagaaaagcaattttaaaagaacttgaacaaaacgcttatgttcgtgtgggtacactgagcagcatgttcggctgcactgagatgacgatccgcagagacctgaatgagatggcggaggaaggcctgctgaaaaggacccacgggggtgctgtaaaaataggaaagaattttgtgactgacaatgtaaaagacttgctgtacagcaatctgcataataagatatacatagccaggcaggcgtacaaagtcatcagtgctcaggatactatatttttagatgatgcaaccacctgcctgtatctggcaaaggaaattaagaaaaatgagaaaaaaccggtaaatatcataacaaacagtgtacttttggcattggaacttatgcaggcggaacatgtctccataaagattatcggaggagatgcggccggcaatctatctgcgactgtggggcaggaggccgtcgaacagatcgcgcgatgcagggcggacaaggcgtttatcggagtcaatggcattgatttcacggagggaatcacagggattgggtacccccagatggagattaagcaggccatgttaaaaagtgcaaaagagacctacgtgctggcggacagcagcaaattcgggcatatctatctttcccatatctgcaatatcgatcaggttacggccgtgctcacggatgggaatctggcggcggcatttcaggaagatgccagggcccatggcttcccggttatctggcagacgggggcgaagaaaaacgaagaatgaatacagttcggactagtcgggactgttatgaatgaagggagcaaatatgagcaaaacaaagttaagtgaaaaggaaaagtgccaggcagggctgctctacgatgccaactataatcaggggctggcggaagaaagaaacagatgcaaggatcagtgctggctgtttaattcctgccggccttcggagcaggaaaaacggatgaacatcatgaaggggattctggggaagaccggcagctccttcctgattgagcagaccttttggtgcgattacggatacaatatagaaattggtgaaaatttttacgcaaatcacggatgtgtcatcctggatgcggccagggtgactttcggagacaatgtcttcatcgcgcccaactgcggattttacacggccggacacccgtacagcccagatctgcgcaaccagggtctggagtatgcaaagccgattagcattggtaataatgtgtggattgggggaaatgtcacagtgctgccgggagtgaccataggggataataccatcatcggggcaggcagcgtggtgacgaaagacattccggcaggtgtggcggccgtgggcaatccatgtaaggtgttaagggaaattaccgaagaggagatggaaagagaaaggaggagtgtacaatgaactggctggatttacatatgcattccgtcatcagcgatgatggggaatttgagccggagaaactgatggacatgtgccgggaggcggggctgaaaaccgtggcagttgcggaccataacagcaccaaagctcttggacgggctgccgccagggcaaaagagaacggtcttcggctgatccccgcagtagagctggactgctgcatacggggcagggaactgcatattctgggatacggcattgatccggaatatccggaatatggaaaggtggaacaaaatctgctggcccaggaacaggagagctcaaaaatacggctgaggctggcggaggaagcgggattaatcgtggatcatgatttggtctatgagctggcacatcacggtgtcgtgacaggagaagtcattgcagaggctgcgctgaagaatgaggagaatcacgcattgctgcgggattacctgccggggggaaagcggagtgacaatccctatgtgaacttttactgggactggtgctcacagggaaaatgcgcctatgcaccagtagaatttatttccctggacagagctgtagagattattacagcatcggggggagttcccattctggcgcatcctggcaataatacgagggaagatgagatgctgctgcaggatatcgtgaaagcaggggtccggggaatggaagtattcagcagctaccatacggatgagcaggtggagttctacctggactgggccatgaaacggcagctgctgatcacggcaggaagcgattttcatggaaagacaaagccgtctatccatttgggccgtatggatgtaaaagggctggaagataaaatttataaagaacttatggatgcggtttaaaaggagggcatagattatgaatgtattataccaggaagtgccgtggggagcgggcgtatggacgaacgaaccggcggaagtgaaaatagaagacggacggttgaacgtaacggctgtgcacgaaagcgattattgggagaagacactttatgggtttcagcacagggacgggcatgcgctgctgacagacctgaaacggacggaagctatggaagttacatttctcctggaggattttcaagaattatatgaccaggccgggatgatgttatggtatgacgacgtacactggatcaagatgacaatagaagtgattgacaacgagccgaatatttcaattgtagtaacggatgtctactccgactgctcgaactttccggtaccgtcctgggatggaaaacatgtgacattccgcgtgtctccgtttgaggatgcggtactgatccgtgtgcgtaccggggacagcagatggatgaccatgcggctcgcgcgatttccttatacggatgggatgaaagcggggccgctggtatgtgcgcctattagaaaagacttccgggcggtatttacacgctggataaaaacagagactgataagggacagcatgaagatccgccgatcttataagaaggggatgctgttccctttcttttttagtaggacgaaataatgttaacagaaaagactccggtattagaacatttaatatcctccaatccttatgcaaactccgatacataaaatttataggacacattagattacaggataaaggcaaggcaaacaaacagcccaataagctgtgcagcagaaagaattggaagcgcagtagaagggtgtaccttaaaatgttgatatgtatataaaaaagttgtaatagaaataaacggaaagattgatatataatatgactaaaaggggtctgtcccctctgcaaaagggtcagccatttttgcagaagggacagacccctttcatgtggtataatggtctcagcaaaagaaaaattcggaggtgattgcagcatgtacagtatcttgatcgtggacgatgaaaaaaaggagcgtgagggcatcagcaggctgcttaagcgctatcattttaatttaaagatcagccaggcagtaaatggtgaggaggcgctcaaagattttgaaaagcatgagtatgatattctcctgacggatattaagatgccgtttatggatggaatacagctaatcaaggaggtacaaaagcggggattgaaccccatttgcattatctacagtgcttacggagagtttgagtatgcgcagaatgccatttcactcggggtgctggagtacttgctgaagccgatccgtctggatgcgtttgaagacttgttccataaagtgattgacctgtgcagggagaaggaggaaattgagaaggagaaggagcagacaagacaggcctatgaggaggtcgccgcttacaggcttagctggaatcttctgggctatctggaaggggatagagcagccgggaaaggggagctgacagtttataaaaaagagacggtacaggagctggaagcagaatttgcgtttgataaaaatgtctgcgtaccagtgctgatctcctgttattccaacctcttctccatggagtgggaagcctatcaaaacgagatcgaaaaacagctcggaggggaacttcttgtcattaataaagcagataaccagattcttgttcttgtaaaaagagaagcacagactttccgggcaaaagagctgaaaaagaaatgtgaactgctcattgaacaatcgaaaagaaaatatcagaccgatgtatttatcatcatcggaagcaagacggaaagtttgattcaactgaagaaagagtatgaagagatgaaagaccagttggattatcagttctttgtatcggacagtatgctgattgtgcatgacgaatcctattttgtgaaaaaggagcaggacatgctgactctgtactttgagcgtatctttaactgtgcaagaatgcaggattacggcgggatgaaaaaggagctggaaaaggtatttgcatatattgagaaacagagcggattcagctcgatatatgtgaaatacacatttaccgatgccgttaagaaaatcaatgagtatacaaaatcagatattgatcttatgacgtatctggaaagaatatatgaggcccgctcttttgaggaagtcagccagacggtatatgaagtgttagatgacatggcaaatcagaagaagaacgatgaaaaagaaaacaggctcgtacggatggctaaaaatatcctatatgaaaagtacggcgattccagcctgagtgtgtcctccattgcggaggagatgcatgtgtcatcggcttacctcagcagtctttttaaagttgaaaccggcgaaaatctggtaaagtttattaccaaataccgcgttggaaaatcaaaagagcttttgaaacaaagtaatatgaaaattggtgatatcgcggctgctgtgggttatatcagcgtttcctactacatatcaatcttcagaaaccatgagggatgcagccctgttcagtatagggagaagatgaatgaagacaattgactggagagcccgttttaaccaaatgcattttttaaataaagtccgcctgatttacagcctgattctgattataccgatcctgctgcttgagtgcctgatctgtattacttccagcaatttcatcaaagagcagcagatgctggaggtgaggagcatgattgagcgtaattaccaggacatccagaatcaaatgaagcagtgtgaaaaatcactgctttatctatccagcaataccatgctaaaagagtttcttgtgaccggagatgatgaatatatgaaacgtctgacgctttccaaaaatgtagcgccgctggtctacaacagcctgctgtcaacccaggatttttcaaagatacttatctattcaggaaagaatttcagcatatcctacgatctgttcaaaaatgattcggaagcgcaggataaggaatggtaccgggaaacggaaaatacaagcaagactctctggtggtatgaagaagaaaaggaacaattctttatcacccgctgtgtcagagattctgtaacggaaaagaaattaggaattatccggattgacctcaaaggtgagattctggcaaaaagctttgaaatattttccggggtacccgtggaaatccgtttgctgggaaaagaaaatgaattctaccgttataccaatataggcggggagggggggcataaaaccggatatgaggcgtctatggatatgggacagtccgactggcagattcagtatgccgtagaccagtcgtatttttcaactatttttcacccgaggatcttaatatcactcatgattgtcatgcttctgcttgcatgtgtctggatcctggttaaccgcagtacaaagtacctgctgaagcatctgtaccggattattgacggtgtaaaaaaggtgaatgacagcaattttgaaatcgaaatagatgagtcgtcgggggatgagatcggagaattagcaaaaagtatcaaccgaatgttgaaaaaaatcaggatgctgatcgaggaagtgtataaatctgagctggacaaaaaaaatctcgaactcaacctcctgcagtcgaaaatcaatccgcattttttgtataacaatctctccgccatcaactggatcgcgattgaaaagggggaggacaggatttatgaaattacgacgcagatggcaacattttacaggacggcgctgaacaggggagtgaatatagacaggctgcgagtagagattgacaatattatgtcttacataaaactacagttatacgctcatgaggattcttttcaggcggaatatgagattgaggaggccttgctggacacccggatccctatatttattatgcagcccctggtagaaaatgcaattgagcatggaatcgacacgctgcgggaagacaaaggtaagattaggatacatattttctcagaggacgtctggttagtgattcatatatgggataatgggaaggaactgtttgggcaaatcggagactcagagctgaattctgaagaatttggatatggcgtcagtaatgtagataaacggataaagctgctgtgcggtgaatccagcggagtgaagatccgggcagacaagaccggaaccacttcggaaatacgtctaaaaaaggatacgatcgtattggatgcaaaatcttaaaaagttgataaccagttaaaaattttattattttttcaaaagaatgccatagctataatgaatatataccaaagtagacaaaaaaagaaaggggattgctatgaaaaagaaaaaagtacttagtattttacttgcagcggttatggcaacagcaatgatggcggggtgcggcggaaaagaagaagacacatccacaggcgaaaagaaagaaacagaaaacaaaacggtcagcataatgggctggtacgacgaggatgatatggaaggtgtaatcaatgctgtgaatgaacagcttgacggagcatatacgctggagtatacctacgttgcactttcagactataacaatgtgcttggcacccagctggcatcgggtgaaggcccggacatcgtgctggatggagccgaattcccggcgagggttaaggcgggtaatgtggaggaaattacggacaaggattatgtaaaagaattcagtgaagccgggctttctctcgcaagcaaggatggaaaagtatacggaataccgtcctatggttggttttccggtatgtggtacaataaagatattttatcagaatgcaatgtagaggtaccgaagacatttgatgaatttgtggcagcatgtgagaagatccaggcggccggacatcaggccatgggattcgggctcgcagacgcggatacggcgcaggcctccctgatgggatatcttgaaaattcattttatcacaataattccgacaattctgacggtatagattttgatgcaaaatttgccgcaggcgaggctacgctggacggaaatatcaatgactgtgttaaaaaatggtatacattaattgagaaaaaaattatcacaccggaaatgcttgggatttcgaatcaggatgcactgaatacatttaaagcgggggatgttgcgttcttcaatgggggcccttggcagtatacggagatcaaggaagcaggagtaaactttggcctgatgccgcagctgagcgaaagtggcgaaaatgtattcaccggcggcggtccggctgcaagcctaggaatcaatgtaaatgcggcaaacaaagagggcgctgaaaagacattggaggcatttgcttctgtggaggtgcagcaggcatttattgatgcgaacccgggatcaccgagttacagaaaaggtgtggagactgaacttccggatgagtatgcagagatcgcagagtgcgtcgaggcaggcaatattgctgtcaattgggaccgctggtctgtcaatatgccgtcacagacaatgattaatgaatccattgcacagatccaggggatggtatcgggggatttaacaccggatgactatgtaaaggcaatggacgctaaggcggattcgattcgatatgagtaaggctgataaatgtagtaaaaaataaaagagcgcaggctgtacgggatcttgtacagcctgttttttcgatttataaaaaagacttttcttgtgaaacctctcgtttttaattgcctgagcgcaacagttgaaaaataaaattataaacaattaccataggttgaatctatgagtacaagcagtctgaaaaaatagtttgagaatggaaacgggtagaaattaaagcattagttaaatagtgggattaggaaatcttatcgactttgaattcgatttgaggtgttagcttgtccaaaagaatagtagatgaacgagaactaatatgtatacgttctttttttaataaagagcgaggtcgttgatttgattcataatcacgagccccttgtttaaaagttgaacaacatgaaaaatcacatttagcagagccatctgcatttgattggattatgaatacaaaactttttatatctgagcgagaggtaatgaggtaatccgcttttatttgtgtataaaaagggtacatatgtggcatatatgaaaaaagcataaattcaatgtcaagagtatccttcatccggactaatgcttctagcctgggaactaccatttcattgtattgagcagctttcttgatctgctccagttttattgtaccatcaagaatttgggaaataattttttttcgattatattttggaagagagagatctttgagatactgaaatcctgcgagatgaggaaaatcttcagataaaaaggtgaggttaatagtatagagtttgtttttataaccataggtgaaaacatacttataatctgttagttcgttccaaacagaagcagcctgataaaaaatatcatttgttgaagatgtcagatattgtccccccattcaaagaaagatagagtgctcagataataaatgagaccttgcatgagcaaggccccattaatgcgttttcgttcgattcctaagaatctattcggtttgtggttaccgcataacccacgggcaggctccacaatcagctgcatgccgacacagttaattgcttcaacacctacgatagctgatcactgccgctatcctctaaaagcattataacacaaataagctttaagtcaagatctctatgagcttttttgaactcggggagccagatcattgttactgttcacaccctgcgggcgtgcacagtaacggcatctgcccatttaaagtcgcctacggcgaggggtgttatgcgccagtggcgcatgtttagcacggaccgaagccgagcggagaccagatgctccgagaccatcacgtcatcggctccgatgccgtgcagcggggtgcatggctccgtgaatgtaatattgagttcactgttattatatgtagatttgataaaaaatttgatgattagataaaaaatttattatataaacagatattcctccatcttataatgaatttataaaagagatgatctgaaaggaagaggaaaaaatgaagaaggcatacaaaatgaaaaatggcgcgccctatgtgattatggtacttccggcgcttttggtttttgtcacgttttttattctgccgctaatatttaccgcaaagtacagtttttacagctggactaatttttcgcaggagattacatttaacggcttagagaattataggaagatatttgacgaccccattctggcaaagggaatcaaaaatacacttatttttgcttttgtaacggttaccgtacagagcctgatttctctgcccgtatcggtttttctgaattcaaaaatcaaagggagcaatatctaccgcgcgatttactttgcgccggcagttttgagcacattggttgttggttatctgtggaaatatctgatgtcctccagcgactacggttttattaaccaggtacttaccggaatgggatttgagaaggtgaattttctgggcaatgcgcaaattgcgctgttcgctattattacgatctctgtgtggcagtggtttggctggtccatggtgatttatctgggcagtttacaaagcataagtgaagagctgtatgaggccgcctcggtggatggggcgaacggactgcagaagttctggcacattacaattccgggactggcgccggccattaagatcaattttgtaacgagtaccatatcgggcctgaagatatttgacctgattctggcaactacaaacggaggaccggcacatcagacggagacgattctgtccctgatgttctccaagttttcggatggaaattatgggtatgcatcggcctttggtatggtatttttgttagtcagcatgctggttgcggcagtgatgctaggagtatttaagaaatgggaggatcggctgggataatgaaaaagaaaaagatctatataaacgttttgaagcatttgattttaattgcgctggcggttgttgtactgattccggtttattatctgattgtgaccactttcaaatcaggggccgaggctgctatgaatccgatggggcttccatcctctatagattttagcggttacataaaggcatttcaggatatgcagtatccacgggcatttaaaaatacgctaatcgtcaccgcatgttcggttgtggggattatatttaccagttccatgtgcggatatgtactgaacaggaaagggaaatatagaatcacacagtttgttttcctgctgatcttatcaggcatgatgtttccttatcaaatgtcaatcatgggactttacaagctgatccgcgggatggggcttatgaactcgctgctggcggttattttaatcgatattgcaattaatattccatttgctacttttttgatgaaaaacttcatcgccaccgtcccaattgagctggaggaggctgccaagatcgacggcgcaggagtgttccggacattttcaacgatcacgtttccgctgctcaagccggtgattgctaccgtggcgattctgaatacactgaatgtatggaatgattttatggggccgctgtacttcttacagacaagggaaaaggatgtcatcctgcaggaggtttaccggaatatcggtcagttttccacagactggaccagcctgttcccgatgatggtgctgggcgtactgcctcttctggtcttttacctcttcatgcagagatttattatcagcggtgtgatggccggatctgtcaagggataggaaggagtgacgacaggatggagtggaaaaccagctgggggtatgagcccattgactatggaaaaacgatcgggtggatagaagaaacggcctgcaggatgtatgtaaaaaataatctctcaggaaatcgcgtaagagtcagattttcaaatcgttttggaaatacgccgctttattttcaggcggtcaggatttcagacgggcggagagcgcgggcggttacgtatcaggggagaacagagataaccatccatgcgggtgaagaattttatagtgatgctgtgaacctgcctgttctggccggaaatgggagacggcgtgcatcccaatacagaaggtgggattttgatggccgaggaagtggtgcataagtgttttgtggaaaggggaaacgtatgaaaataaaaacgaaacacagtgaatggaatcaggaatttgtgacaaaggaaaatgaaggaggctatctgacatttttaggacataaagacgataaagcggggatgaactggatcgaaggcagcaggctgtggggggaggcaatatgcccggttggcatacaagctgaggtgtccagggaatttacggaggccgggaacttaaaagaaacttaccggtttcaaaatgtctccaaatttcccgtttttctgcaaaagacggatatcgggatctgcgctacctttaatgacaactacgaggaggcagagaagtgccttgattataaatgccatacgcacctgttctgcggaaatcatgcggcctatgttatggcgcttcgtatgtccggggagggagcaaacctgggattaaaactcctgcaggggaatattgggtcatacagtattgaacgggatctagatcagaggagtgatgacaggggggactttattctccaccctgtaatcggctgtatcgaaccgggtgaggagtcggtggttcaatgggaacttttctggttcgacacgagggagatgttttacagtgaacttctggaggcgccgcatttcccggtagcatttttagatcggagtacgtattttaccggtgagactatgtgttttaaagccgcggtaaagggagaggctgatccggcggcagtcaaaattatgctgggagccagggaaattccttttactataaagaaagagaaggagattctctggatatcggcggaatatccggcagaacaagaaggggaataccggtttcgaataaacatgtatggcaaagaaacatttgcgttattgtactgcgctgccagacttgaggatatggtggacaggaggtgcaaattcctggctgaaaaacagcagtttcgcggcagcagtacttctttggacggggcatatctaatctatgacagggaggaggactgcctctgctatgatcataatactgatgaccataacggggggagggaacgcctggctatgggggctttgatggccttatggctgcagcgcagccgggacgggaatctggaaaacagcctgaaggcatatgtaacatatgtctacagggagctgtaccgcagaggcgaggggattgtatacaacgatatttcctataatctggattggcacaggatgtataactatccctggatggcggtctttcagcttgaactgtaccggctttggaagaaacaggagtatctggaggatgcttatcaggttatgaagcggtattatgaacagggggggaccggattttatgcaatcgggatccctgtttatgagctccgaaaagagctgctgaaagcaggtatgtccggggaggcggaagtaatggcacattatgccaaggtgcatgcggatcatatttgcagtaacggagtgtactatcccgcatcggaggtttcttatgagcagagtatcgttgccccggcggtgtcatgccttcttcagggataccagataaccgggaaggaagcgtatttaagagaagcagaaaggcaattacgcatattatcattgtttaatggaagacagccggattaccatctttttgaaaatgcgatccggcactgggacgggtattggtttgggaaaaacaggatgtatggggatacatttccacattactggagcgcgctgacaggggtggagtatgccagatacggagcggttaccgggaaccactgcatggatgcgcaggcttcggcatcactgcggggatgcctgaacctgttctttgcagacggctgtgcatcctgcgctatggtctatccggaaagggtgaatgggaggaaagggcattactatgatccctgggcgaatgatcaggactgggcattgtattatgcattgaagtatcaggtgattacggaagggggacgctgaaaatataaagtataattaatcataatagccattgttagttttaggctgacaatggctttatctaatggacttattaccattcatcatatttttccttcgctatctgtgtatacttggcaacgaaatccgacttcgagtccgtatagctgtccctgtcatgttcaaactccttccagagcctcagctttagccgctcatattcatgagcaatatccggattttcaattagataatccctgaaatacaattcgtcatgatctccaatatatctcaaatgcagatgaaataccctttcagcaaatccattttccgtgtaacctttattaaaagaaattctgcggtttccccgggacatgcatagataaccattgtcttctaaaatggactttataaactccatatcagaatcatccggcacttccatcagaatatccacaataggcttggcccaaatcgtacaaacagaggtacttccgatatgactgatccgcattctctcacgatgcggcagaatccccataagaaggcttgtctcttcctcataccattccttccatactgcttgatgcggttctaaaaaaatgggaaacaattcccacaaatcttccaaactcatctccgaaagcgtactgctcattaataaacctcctaaataaaataacagaacatggcgttgcctttacaaaaataaatgctgatttattatagcatacatgacaatcatcataaacaacctaaagttaagtacatcgtaaatataacaaaaataaatggtgtatttttgtgcaatctgttagttttgagtagaattttacaaaattattgccaatattaaatgaataatatatattaaatgtatcatacatttgagacaaataaacaggaggttagttatggggaaaggtaaggtatcgaacgtaagcggaaatggcacgcttcttaaaaatttaaaggcaatgggaattttgtgggcgttaattttaatttgtatcattgcagctattatttcccctaattttctgagaccggcgaatatcgtcaatgtggtgcgctcggtttctttaaacgggattatcgcaatggggatgacatttgttgtgctgaccggaggcgttgatctgtctgtcggttctactgtgggcgtggtggctgtatctgccgcaattatgatgcagaaagggattcatccagttgttactatagcagcaagccttctaatcggaattgttctgggactgatcaatgggatcggtgttactgtggggaagctggccccgttcattatgacgctgggtactatgacggctctgcgcggcgttgcaaggtatatcgcgaatggctctccgcagaactggagggattccggtatagacttttcctttttgggacagggcagcatcctggggataccggttccggtgtacatatttttagcggtgtttgtggttgcattttacgtattaaagtatacagaatttgggcggagcgtctacgcgttgggggacagccgtgaagcggcaaggctgtgtggaatcaacacgaagaaggtagaaacgctgtgctttgtgattactggttttctttccgccttgtctgctattatttttatctccaggcttggcattggacagcctgaagcgggcgaaggttatgaactggatgccctggctatggtttacattggcggggcaagcaccgcaggaggaagcggaagtgtagtgggcacactgattggtgcgtgtctgatctctgtaattaacaatatcctgaacctgatgggaatttctccatttatccaaaaggtaattcagggtgtcattattattcttgcagtcttgctggagcgtagaaccaagaagaacagataagcaacagcagtgcaaataaaggctaacagcacataggtgctttagttcatatcaaattcaaaaattataagaggaggaaaggtgaatgaaaaagaagatttttagtgtaatgttatgtatggcaatggcagtgaccatggcggcagggtgcagcaaaggagcatcaaatgacacaaaggattcggaaagtactgcaaagacagaagataagggcgaggcttccgacagcggcgataagaaatttgtgatcggtgtttcacagggaacaatgaaccatccattccgtgtggctatggtggatgaaaatgtaaaatatgcggaggaaaattatccggaatttgaatgtattacaacagacggacagaacgattccgctacgcaggttcaggatgtggaagatcttctggcccgcggtatcgatctgctgctgatttctccgctcacctcggatgcgctgacgcctgtttgtgagaaggcaatggagcaggggatcccggttgttacgctggacagaaatgtggaatgtgacgttacctgttttatcggggcagagaacaagcctatgggcgtagcttctgcagataagctggctgaggccctggacaagaagggaaaaatcgtggagattcaggggacggcaggtgcgtctgcgacaatcgaccgtcacgatggatttgcagaacagctggagaaggaatatcccgatatggaagtaattgcaacccaatactgtgactacctccgtgaagatgcaatgacatttatggatgatactctccagagatttgggcctggtgagatcgatgccatctactgccacaatgatgagatggcactgggcgcgctggaatcgctgcgtgcggcaggccgcgaagatgaaggtatcctgattgtaggaatggatggtacggaggttgcattttcagagattgaggaaggcaatatgttcttcactgttgtatatccatactgtgcaccggaaggaatgcaggctgcatatgagattctggagggcgacggggtggaaacccgctgggaactggatacaacaattgtggataaggataatgtaaaagactggataggtaaaggactgtaaacaggcacaggaggtggcagggatgctcaaaatgaaccatatttctaaaagctttccgggagtgaaggcgctggatgatatatcaatttctgttgaaaagggtgagatccatgcgctggtcggcgagaacggagccggaaagtctaccctgatgaagattttatcgggggcttattctctcgacagcggggagatcctgctggacggggaaaagattgagaatacatcgcctgcaaagatgattgagaagggaattgcggttatttatcaggagctgatgctgctgcctcaccgtactgtagcagagaacatttttctgggcaggtaccctaaaacaggcttgggaaagatagattataagaaaatggagcgggatgcgaaagcggtcctagatgaattgaagctggatctggatgcccgggcggtggtggaagatctgagtgttgccaagaggcagatggtagagattgccaaggcaatgtcccgcaatgccaagattgtcgtgttggatgagccgactgcggttttgggcgacagtgagctggagggattgtttgatattgtgaagcggctggcgtcggagggtgtcacatttatctacatatcacaccggctgaaagagatttttgaactctgcacgaacctgacgattatgaaagacgggaaaatggtagagagcggacctgtggagcaatatacgacggagatcctggtcagcaggatggtcgggagggatgtgaaggatatttatcccaaaagaacccggaatatcggcgaggtagtgctttcggttaaaggactgaccaggaaaggggttatagaaaatattaattttgacctgcataagggggagattctggggattgcaggcctggcaggagccgggcgctcggagattctgagagcagtcatcggggcggatcccatagatgcgggtaccgtggagctggaaggccggccggtgacatttaaaaatgtaaaagaaggcattctggccgggctgggaattgttccggaggagcggaaggcggaagggctgatgctgcagcagaatatgatttttaatatgaccgtgcctgcgctgagaaagtataagaaccgcttcggcaggctgacgccggcaaaggaggcggaggttaccagaaagtatattgagacgtttcacatccggccaggttctcctcatacgattacgaattttatgagcggcggcaaccagcagaaggtggtattgtccaaatggatagccgcggactgcaagattctgctggtcgacgagcccaccagaggtgtggatgtgggagcgaaggaagagatttatgagatactaaaccagctgattgaaaatgggctttcaattcttatggtttcgtcggaactgccggagctgttgggtacatgcgaccggattatggtgatgaacgaaggacggcagacaggactgtttgatattgatgaatgctcggaagagacgctgatgacatttgcaacaaattaagggcaaggtggcagtatgtttgatttatgtgcaatcggggatgccctgattgattttatcccggcgcctcagtatactcctgaggcacctgtttaccagtgtgaggtgggagggacggtggcgaatctgctgacggccggaagcaaactgggtctgaacacgatgtttgtggggaagattggcgaggattgtatgggccatctgatccgggagaagatggcggggtatggggtcagcatggacggatgtgttatggatccgatgcattttacgactcaggcatttgtgacgctggataaagacggggagagaagcttcagtttttctcggcggttcggggctgatatctggctccgggaagaggaactgccgattgaaaaggctgtagaatcttccatggctgcattttcgggaatgtgtatgacggatgagcctgtgcgttctgcaacctggcggtttttgcgtgcggtgtacgacaagaagatccccatcgtgctggatgtaaattacagatataatctctggaaaagtgaagaagacatgatacgcattatgcgggagacgctgccctatgtaacgctttataaatcctcggaggaggaggcctgtctgctggcgggcgccgaaagctgggaaggggccgcggagatactctcgggatatggatgcagaattgttattataacgctgggggagaaagggtcttattactatatggatggcaggtccggtctggttgaatcttatccgatagaggccgtggacacgacaggagcaggggattgtttctttgccggactgctctatcagatcaagaaaaagggcggcattgacaagatcgtctcggaagatttcccacagatcctgagctttgcgaacgccgccggtgcgctggctgcgacaaagcggggcggtacaaaaggttcaccgtcgctgcaggaagttacaagctttctggctaatcggaaataagctgggcggcaggtcctcccgatcgtatttggattcatttacagattgggtttcgggtttaaaaactgtattcagataagtatgagtaatatcaaaatgaaattaactctaaataagagttgataataaatcataaagagaaggcaataggaggagacaaaatgaaacctgataaaaaagcatgtgacatgacaaccagagagctggccgcatacattgattattcggtcttaaagccggagttcacagaggaagagatcattgagctgacgaaggatggggtaaaactgggatgtgcaacaatctgcatcaaccccggatatatgaaactgtgtgaaccatatgtaaaaggaacagacaccatgctctgcccggtaacagattttccattcggaacaagctccacagaatcccgtgtacagcagatcgaaaatgtagcaaaatacgatactgtaaaagaagtggatatcgtagcaaactttggatggataaaagcaggattatacgacaaagtaacagaagacttgaaaaagtgcgcagaggcggcgcacaaatacggaagagaaatcaaggttatcctggaaacagatgccttaaatgaggagcaggtaagacggggatgccactgctgcatagatgcgggagtagatttcgtaaaaaccagcaccggttttctcaccggcttcgaggcccatggagctacaccggaaattatcaaagtgattatggaagaagtggccggaaaggcaaaagtcaaaggaagcggatgcatacggacgagagaacactttcttcagctgatcgatatgggaattgacagaatgggcgtggggtataagtcggtaccggttgtattggggtgaaaaggcagcgaaagaggagcgaagagggcagcaaaggggtcagcaaaggggtcagacccctttgaacaccatattcagacaataacgaagagatgcaggagttatccggcatctttttgtattataaaggataaattatctattaatccagggaaaaccttcattaatgggagaataatagagtatgcagatctgctggagaaataaatattcagaattgctggaaaatggaaggcaaaggggtctgacccctttactgtcttgtcacctgtaaacttatgtgctataatgatgagaatttaccgcagaagttttctgcaaaggaatacataagccccaaggggcaggagaggtgtgaaaaagatgacaatagccgatgagattaataggttgaagaaggaaaaaaatgctgtgattctggctcactattatgtgaatccggaagtgcaggacattgcggactacataggtgattctttttatttaagcaaggttgcagtagagcttacggagcagacgattgtgttctgcggggtttcttttatgggagaaagcgccaaggtgctgaatcctgggaagacggtgctgatgccggatgcttcagcggactgtgcaatggcgcatatggcggatactgacacgatcaggaagatgcgggagcaatacgaggatctggctgtggtgtgttatattaattccactgcggaactcaaggagcattcggatgtctgtgtgacgtcggcaaatgcggttaaaatagtgagggccatacccaataaaaatatcttttttatcccggacagaaatctggcccattttgtggctgagcaggttccggaaaagaattttgtttacaacgagggatactgtccggttcatgaaaaaatgagtgttgcggagatcaggaaagcgaagaagatgcatccggaggcggaggttctttcccatccggagtgtcccaaggcagtgctggagctttcggactacataggcagcaccaccggaattattgactatgcgggcaaaagcggcagcagagaatttattatctgtacagaaaatggagtccgccacaaactggagaacgattatccggaaaaaaagttttattttacggagacagaacctgtctgtgaggatatgaaaattattacactggaaaaaatactgcatgtgctgaagaccggagagaatgaggtacgggtatcggatgaacggagagagaattccagaaaaccactggaaaggatgctggagttggcgaaataggaaaggctgtggggctgttatggaaatgaaaacagaagtcgtaattgttggtactggtgtggcaggattattctgtgcgttgaatctgccgcgggataagcagatcctgatgcttaccaaatcggatgtggagagcagtgattcttttctggcccagggcggtatctgcgttctccgggacgaggatgattacgacagttattttgaagatacaatgaaggcagggcattacgagaaccgcagggagtcggtggatattatgatacggagctcccgggaaatcatagacgacctggttggatatggagtggagtttgagcgcagcaaagacggtttcgcctatacgcgggagggcgcgcattccactcccagaatcctgtaccatgcggatattacaggaaaagagattacgagtaagcttcttgcccaggttaaaaggcttaagaatgtaacgattttggaatatacaactatgaccgatattatagaagaaaacggaatttgcaccggggttctggcagagtcggaggcagacggtaagatagagatctacgcggattttacggttctggcaagtgggggaatcgggggaaattataaacattccaccaattatcctcatttaaccggggatgccatagaaatctcgaaaaaacacggcatccgtttggaacatctggactatgtgcagatccatcccaccacgctgtattcacggaaaccgggcaggcggtttttgatttccgaatcggtcagaggagaaggggccgtcctttacaataaaaaaggggagcgttttgttaatgaactccttccgcgcgatgttgtgacaaaagcgattcatgaacagatggaaaaggatggaacagattatgtgtggctttctatgaaacatattgataaagaaaccctcatgagccatttccctaacatctgccggcactgtctggaagaaggctatgatgtgaccagagaatacattccggtggttcctgcccagcactatttcatgggcggcatctgggtggattccgacagccagacatccatggacagcctgtttgccgtgggagaaacaagctgcaatggcgtccacggcgccaaccgtctggccagcaattccctgctggagagcctggtgtttgcaaagcgggcggctgcaaaggtcaaagagatgtatgggacagaaactcaaaaggaagaaacggcgtgaacagcaggaaaatggcgcaggcttgccttaaaccgaatgcttgcgggggaccggattaaataatcagaaaatagaagggagaacaggacgaatgaatgatgttacaatgacattacaggctgaccacctgattttagaggcgctaaaggaggacatttccagtgaggacgttaccaccaatgcagtgatgaaagaagcagtgaaaggcgaggtagagctgatctgtaaagaagacggaatcatcgccggactccatgtatttaaacgggtattcgagctgctggacagtcaggttatggcagaattttactgcaaagacggcgatcaggtcatgaaaggccagctcatgggaaaagtaacaggggatatccgggtgctcttatcgggcgagcgggtggcgctgaattacctgcagagaatgagtggaatcgcgacctatacgcattccgtagcggcacttctggaaggaacgaagacaaaattgctggatacaagaaagaccacgcctaatatgcggatttttgaaaaatacgctgtgcgggtaggcggtggatacaatcacagatataacctgtcagacggtgttttactaaaagataatcacatcggcgcagcaggcagcgtggcaaaggccgtacagatggcgaaggactatgcgccatttgtgaggaagattgaggttgaggttgagaacctggatatggtaaaagaagctgttgaagccggcgcagatatcattatgctggacaatatgacgacagaagagatgcaggaagccatccgtatcatagaccacagggcccaaacagagtgttccggaaatgtgacaaaggagaacatcggcaggattaccgcgcttggtgtagactatgtttccagcggagcgctgacacattccgcaccaatcctggatatatcgctgaagaatcttcacgcagtataaatatggacggacagaaaggcaggtgaaagcatcccatgatgacaggttctgaacgcagaaatgctatagtgagccatataaaaaacagtgccgtaccggtatccggcaaagcactggcacaggaatatgaagtgagccgtcaggttatcgtgcaggatatcgccttgatccgcgcatccggacacgatatcatttccacaaacaggggatatatcctgaatacgccgaagtccgccggccgggtgtttaaagtaaaccatacggacgacgacctggaaaatgaactgtgttccatcgtagacctgggcgggcgggtcgtcaatgttatgattaatcatcgggtgtacgggcatatggaggcggaacttaacatcaattccagaagaaaagtcatggagtttatggaagacatcagaagcggaaaatccagtccgctcaagaatatcacatcgaactatcactatcataaagtggaggcagataatgaagagaccctggacatgatagaagagatgctccggagaaaaggatatctgatagagccttagatagaatactttatagcattaaaaaagccggggctgtgggctccggcggagaaaggtatgaaaaaaaatttatctgaaaaagcatttctgctttgtatgattataatttaaacaaaaaatgtgacaaaattgtgttatcagcattaatagtttgtaaaagaatcatttaaactttatgaagggatctttagaatttataaagtcatacccttgacattcggaaatggctgtgatacgctttttaacagaccaaacagaaatgaaaacgcagtgacggagagagtagtctgcaggacattccacagagaattcccacagttcctcaacataggaacgaacgctgagagggatgaatgaagggcagatgaagatggcttctgagcggcgcaccgaacaaagaacagacgagaggcagtccgaggaattctttagtatgccgccggaggttctgtgcaaggctgcgatgggttcgccctttacagcgaaggagtgctggctggcacttactgaggctctgtccgtgaggtcagagtgaattggaagtggtaacacggataggatccgtcttcttaatattgattaagagggcggttttttatgatataggaaattccactggaatttcctatatcataaaaaaccctccgggaggatgcacacgccgcgataaggtatatagccgcaaggcggcatcgcggcggcgccaaagtgtgcaagcccctcatagtgagggggggaagcccatgtgggcttgcccactttgttctgttataagaataccggcctgacagcgttttggtacaggtcaacagtgaaatcggggcgtcccttccacggacagggcggcgctcttaaaggagagagaatcatgtcagaaaaacaaaagtattacattacaacagcgattgcctatacatccggcaaaccgcatattgggaacacctatgaaatcgtccttgcagacgcgattgcaaggtacaaaagaagccaggggtatgatgtgttcttccagacaggcacagatgaacacggccagaaaatcgagttgaaggcagacgaggccggaatcacccctaaggaatttgtggacaatgtggcaggcgatatcagaagaatctgggatctgatggatacctcctatgacaaatttatccgcactactgacgaagaacacgaaaaacaggtgcagaagattttcaaaaagctgtacgaccagggtgatatttataaagggcattacgagggcatgtactgcactccatgcgagtccttcttcacagagtctcagcttgtggatgggaaatgccctgactgcgggcgtgaggttcagcctgcgcaggaggaggcgtatttctttaaaatgagcaaatatgcggaccgtctgatcgagcatattaatacacacccggagtttatccagcctgtgtcccgtaaaaacgaaatgatgaacaatttccttctgcctggcctgcaggatctgtgcgtatccagaacatcatttaaatggggaattcctgtggaatttgaccctaagcatgtggtatatgtatggctggatgcgcttacgaactatattacaggtattgggtatgactgtgacggaaaccatacagaacaatttaaaaaagactggccggcagatcttcatctgatcggtaaggatattatccgtttccatacgatatattggccgatattcctgatggcgctggatcttccgctgccgaagcagattttcgggcatccgtggctgctgcagggcgacggtaagatgagcaaatccaagggaaatgtgctgtatgccgatgaattggttgatttcttcggtgtggatgccgtgcgttattttgtactccacgaaatgcctttcgagaacgatggcattatctcctgggaactgatggtagaacgtctgaattccgacctcgcaaacaccttaggcaacctggtgaacagaaccgtgtccatgaccaataaatattttgggggaacggtatgcgataaaggcgctgcggaggaagtggatgcagacctgaaagcggtcatggaggggacgccaaaggcagtagaatctaagatggaaggactgcgcgtagcagatgccattacggaaatctttaatttatttaaacgctgcaataaatacattgacgagactatgccctgggttcttgcaaaagacgaggccaaaaaagacaggctggaaaccgtattgtggaacctgatccagggaatttccgcaggagccgtacttttggaatccttcatgccgtccaccagtaagaagattctggaacaattgaatggaggccatgtcacagataaaccagaaattctgttccagaggcttgacctggaagaggtactgaaaaaagtagaagagctgcatccgcctgtggcagagactggatccaaagatgcagaagaaaccgtcattgacatagaggcaaaacctgaaatcacatttgaagattttgggaaaatgcagttccaggttggagaaattattgcctgtgaagaagtgaagaaatccaaaaaactgctctgttcccaggtaaaagtcggaagccaggtaaaacagatcgtatcaggcatcaaggcatactacaaaccggaagagatggtaggcaagaaagtcatggtgcttgtcaacctgaaaccagcaaagctggccggagtactgtcagagggaatgctgctctgcgcagaagacgcagatggctgtctcgcactgatgacaccagagaaagacatgccggccggtgccgaaatctgctaaaggggtctgacccttttgcggaggggtcagacccctctgcaaaggggacagacccctccgcaaaggggacagacccctttgaactatcgaaacccttcttctctctttacaatatatagaggccgcttttttgtttccatgtaatctttagagatatactgacccaatacggatatgaaaagcagctgtatcccgttcaatcccaatatcagcagcactacaagcaggattccgctggccgcatagccgaagataaacgttcgtacagccacggtaattccgagcagcagggcggcagccagcaggaggctgccggttgttccggcaagcgtaatcggagcggttgagaaggagaatattccgtctagggcatatctgaacaggcttctaaagctccatttgctgtttcccgcggcacgttccacgttgcggaatggaatccatttggtatcaaaaccgataaatgaaaagattcctttcatatatctgttatattccttgaattctaggattgagtcggccatcgctcggttcatcatgcggtaatccccggccccgtcactcatgttcatatcacagattttgttaacgatcttatagaatccgcgggaaagaaaacttctgacccgcccttctccctcacggtcttcccggaatccggcacagcagtcatagccctcatttttcagtaccctgtacatttccctgagaagcaagggcgggtgctggagatccgcatccataaatacgcagtaatcgccggaagcatactgcaggccggcatacatagcggcctccttgccaaagttccgggagaatgacaggtatttgcagcgcttgtcccgataaaccaggctttgcagtatttctggtgtgtgatccctgcttccgtcatcaataaaaatgaattcacactctgcagtctctatgccgcggactgccttgtctgtttcctgatagaacatggaaagcacctgttcttcattatagcagggaacgataatgctgattttatccatggttcatttcctccttttggaaaatcttatacttacacagcaaataattcgataatacagtgattacgcttactatgatcttagaaggcagaggcggtatgcccagggcgcctgctgtcagccagagcagggcattttctaccagaagcgtcaggaaccttaaacatacaaaagaagagaattcctgcaggatctgtttctgggagtggaacaccagtctgcggttcaacagatacgctgtgataacggctcctccccaggccaatgtattagctg
